(12) United States Patent
BonDurant et al.

(10) Patent No.: US 12,545,914 B2
(45) Date of Patent: *Feb. 10, 2026

(54) ANGIOPOIETIN-LIKE 3 (ANGPTL3) iRNA COMPOSITIONS AND METHODS OF USE THEREOF

(71) Applicant: Alnylam Pharmaceuticals, Inc., Cambridge, MA (US)

(72) Inventors: Lucas D. BonDurant, Brookline, MA (US); Mark K. Schlegel, Boston, MA (US); Jeffrey Zuber, Somerville, MA (US); Lauren Blair Woods, Sharon, MA (US); Tyler Chickering, Needham, MA (US)

(73) Assignee: Alnylam Pharmaceuticals, Inc., Cambridge, MA (US)

( * ) Notice: Subject to any disclaimer, the term of this patent is extended or adjusted under 35 U.S.C. 154(b) by 583 days.

This patent is subject to a terminal disclaimer.

(21) Appl. No.: 17/823,980

(22) Filed: Sep. 1, 2022

(65) Prior Publication Data

US 2023/0133637 A1    May 4, 2023

Related U.S. Application Data

(63) Continuation of application No. 17/689,034, filed on Mar. 8, 2022, now Pat. No. 11,613,751, which is a continuation of application No. PCT/US2022/018630, filed on Mar. 3, 2022.

(60) Provisional application No. 63/308,668, filed on Feb. 10, 2022, provisional application No. 63/156,476, filed on Mar. 4, 2021.

(51) Int. Cl.
C12N 15/113    (2010.01)

(52) U.S. Cl.
CPC ...... C12N 15/1136 (2013.01); *C12N 2310/14* (2013.01); *C12N 2310/315* (2013.01); *C12N 2310/322* (2013.01); *C12N 2310/344* (2013.01); *C12N 2310/346* (2013.01)

(58) Field of Classification Search
CPC ............ C12N 15/1136; C12N 2310/14; C12N 2310/315; C12N 2310/322; C12N 2310/344; C12N 2310/346
See application file for complete search history.

(56) References Cited

U.S. PATENT DOCUMENTS

| | | |
|---|---|---|
| 7,935,796 B2 | 5/2011 | Lee et al. |
| 9,322,018 B2 | 4/2016 | Bettencourt et al. |
| 9,708,607 B2 | 7/2017 | Rajeev et al. |
| 9,771,591 B2 | 9/2017 | Bettencourt et al. |
| 9,796,974 B2 | 10/2017 | Rajeev et al. |
| 10,086,081 B2 | 10/2018 | Nair et al. |
| 10,337,010 B2 | 7/2019 | Bettencourt et al. |
| 10,550,390 B2 | 2/2020 | Bettencourt et al. |
| 10,557,139 B2 | 2/2020 | Bettencourt et al. |
| 10,570,393 B2 | 2/2020 | Querbes et al. |
| 10,934,545 B2 | 3/2021 | Bettencourt et al. |
| 11,130,953 B2 | 9/2021 | Bettencourt et al. |
| 11,198,872 B2 | 12/2021 | Querbes et al. |
| 11,306,314 B2 | 4/2022 | Bettencourt et al. |
| 11,306,315 B2 | 4/2022 | Bettencourt et al. |
| 11,306,316 B2 | 4/2022 | Bettencourt et al. |
| 11,332,743 B2 | 5/2022 | Bettencourt et al. |
| 11,525,138 B2 | 12/2022 | Bettencourt et al. |
| 11,613,751 B2 | 3/2023 | BonDurant et al. |
| 11,834,662 B2 | 12/2023 | Bettencourt et al. |
| 11,840,692 B2 | 12/2023 | Bettencourt et al. |
| 11,866,709 B2 | 1/2024 | Bettencourt et al. |
| 2004/0259247 A1 | 12/2004 | Tuschl et al. |
| 2005/0246794 A1 | 11/2005 | Khvorova et al. |
| 2005/0255487 A1 | 11/2005 | Khvorova et al. |
| 2008/0177045 A1 | 7/2008 | Lee et al. |
| 2010/0010066 A1 | 1/2010 | Fitzgerald et al. |
| 2013/0023579 A1 | 1/2013 | Crooke et al. |
| 2014/0179768 A1 | 6/2014 | Bettencourt et al. |
| 2015/0315594 A1 | 11/2015 | Prakash et al. |
| 2017/0275626 A1 | 9/2017 | Maier et al. |
| 2017/0355994 A1 | 12/2017 | Bettencourt et al. |
| 2018/0008724 A1 | 1/2018 | Rajeev et al. |
| 2018/0245077 A1 | 8/2018 | Chiu |
| 2019/0078089 A1 | 3/2019 | Li et al. |
| 2020/0140866 A1 | 5/2020 | Bettencourt et al. |
| 2020/0224201 A1 | 7/2020 | Querbes et al. |
| 2022/0073924 A1 | 3/2022 | Bettencourt et al. |
| 2022/0073925 A1 | 3/2022 | Bettencourt et al. |

(Continued)

FOREIGN PATENT DOCUMENTS

| | | |
|---|---|---|
| EP | 3 719 126 A1 | 10/2020 |
| WO | WO-2008/073300 A2 | 6/2008 |

(Continued)

OTHER PUBLICATIONS

U.S. Appl. No. 14/132,999 U.S. Pat. No. 9,322,018, filed Dec. 18, 2013 Apr. 26, 2016, US 20140179768, Granted (Continued)

*Primary Examiner* — J. E. Angell
(74) *Attorney, Agent, or Firm* — McCarter & English, LLP; Maria Laccotripe Zacharakis; Deborah L. Nagle

(57) ABSTRACT

The present invention relates to RNAi agents, e.g., double stranded RNA (dsRNA) agents, targeting the Angiopoietin-like 3 (ANGPTL3) gene. The invention also relates to methods of using such RNAi agents to inhibit expression of an ANGPTL3 gene and to methods of preventing and treating an ANGPTL3-associated disorder, e.g., a disorder of lipid metabolism, such as hyperlipidemia or hypertriglyceridemia.

84 Claims, 3 Drawing Sheets
Specification includes a Sequence Listing.

(56) References Cited

U.S. PATENT DOCUMENTS

| | | | |
|---|---|---|---|
| 2022/0073926 | A1 | 3/2022 | Bettencourt et al. |
| 2022/0073927 | A1 | 3/2022 | Bettencourt et al. |
| 2022/0073928 | A1 | 3/2022 | Bettencourt et al. |
| 2022/0073929 | A1 | 3/2022 | Bettencourt et al. |
| 2022/0119815 | A1 | 4/2022 | Querbes et al. |
| 2023/0133637 | A1 | 5/2023 | BonDurant et al. |
| 2023/0287425 | A1 | 9/2023 | Brown et al. |
| 2024/0175030 | A1 | 5/2024 | Bettencourt et al. |
| 2024/0200075 | A1 | 6/2024 | Querbes et al. |

FOREIGN PATENT DOCUMENTS

| | | | |
|---|---|---|---|
| WO | WO-2009/073809 | A2 | 6/2009 |
| WO | WO-2009/134487 | A2 | 11/2009 |
| WO | WO-2010/036962 | A1 | 4/2010 |
| WO | WO-2010/048228 | A2 | 4/2010 |
| WO | WO-2010/068816 | A1 | 6/2010 |
| WO | WO-2010/144740 | A1 | 12/2010 |
| WO | WO-2010/148013 | A2 | 12/2010 |
| WO | WO-2012177784 | A2 | 12/2012 |
| WO | WO-2013/074974 | A2 | 5/2013 |
| WO | WO-2013/165816 | A2 | 11/2013 |
| WO | WO-2014182661 | A2 | 11/2014 |
| WO | WO-2016028649 | A1 | 2/2016 |
| WO | WO-2016/168286 | A1 | 10/2016 |
| WO | WO-2022/187435 | A1 | 9/2022 |
| WO | WO-2024/044542 | A2 | 2/2024 |

OTHER PUBLICATIONS

U.S. Appl. No. 15/068,912 U.S. Pat. No. 9,771,591, filed Mar. 14, 2016 Sep. 26, 2017, US 20160186180, Granted.

U.S. Appl. No. 15/683,999 U.S. Pat. No. 10,337,010, filed Aug. 23, 2017 Jul. 2, 2019, US 20170355994, Granted.

U.S. Appl. No. 16/411,261 U.S. Pat. No. 10,934,545, filed May 14, 2019 Mar. 2, 2021, US 20200140866, Granted.

U.S. Appl. No. 16/443,998 U.S. Pat. No. 10,557,139, filed Jun. 18, 2019 Feb. 11, 2020, US 20190316137, Granted.

U.S. Appl. No. 16/444,021 U.S. Pat. No. 10,550,390, filed Jun. 18, 2019 Feb. 4, 2020, US 20190352645, Granted.

U.S. Appl. No. 17/089,854 U.S. Pat. No. 11,332,743, filed Nov. 5, 2020 May 17, 2022, US 20210171954, Granted.

U.S. Appl. No. 17/158,375 U.S. Pat. No. 11,130,953, filed Jan. 26, 2021 Sep. 28, 2021, US-20210171955, Granted.

U.S. Appl. No. 17/531,885 U.S. Pat. No. 11,306,314, filed Nov. 22, 2021 Apr. 19, 2022, US 20220073924, Granted.

U.S. Appl. No. 17/531,888 U.S. Pat. No. 11,306,315, filed Nov. 22, 2021 Apr. 19, 2022, US 20220073925, Granted.

U.S. Appl. No. 17/531,900 U.S. Pat. No. 11,306,316, filed Apr. 19, 2022, US 20220073926, Granted.

U.S. Appl. No. 17/531,913, filed Nov. 2021, US 20220073927, Published.

U.S. Appl. No. 17/531,919, filed Nov. 22, 2021, US 20220073928, Published.

U.S. Appl. No. 17/531,921, filed Nov. 22, 2021, US 20220073929, Published.

U.S. Appl. No. 17/714,196 U.S. Pat. No. 11,525,138, filed Apr. 6, 2022, Dec. 13, 2022, US 20220235358, Granted.

U.S. Appl. No. 18/380,695, filed Oct. 17, 2023, US 20240195030, Published.

U.S. Appl. No. 15/782,091 U.S. Pat. No. 10,570,393, filed Oct. 12, 2017 Feb. 25, 2020, US 20180087054, Granted.

U.S. Appl. No. 16/712,152 U.S. Pat. No. 11,198,872, filed Dec. 12, 2019 Dec. 14, 2021, US 20200224201, Granted.

U.S. Appl. No. 17/517,733, filed Nov. 3, 2021, US 20220119815, Abandoned.

U.S. Appl. No. 18/337,495, filed Jun. 30, 2023, US 20240200075, Published.

U.S. Appl. No. 17/689,034 U.S. Pat. No. 11,613,751, filed Mar. 8, 2022 Mar. 28, 2023, US 20220290153, Granted.

International Preliminary Report on Patentability from PCT/US2012/043378, dated Jul. 29, 2013.

Gao et al., "Angiopoietin-like protein 3 regulates the motility and permeability of podocytes by alterning nephrin expression in vitro", Biochemical and Biophysical Research Communications, 2010, pp. 31-36, vol. 399:1.

English translation of a Chinese Office Action and Chinese Search Report issued by the Chinese Intellectual Property Office on Feb. 16, 2015.

Watts et al., "Gene silencing by siRNAs and antisense oligonucleotides in the laboratory and the clinic", J Pathol 2012; 226: 365-379.

GaLNAc-siRNA with Enhanced Stabilization chemistry:ESC-GaLNAc-siRNA, Muthiah Manoharan TIDES, (Mar. 14, 2014). Retrieved from the Internet: URL: http://www.alnylam.com/web/assets/ALNY-ESC-GalNAc-siRNA-TIDES-May2014-Capella.pdf.

International Search Report and Written Opinion from PCT/US2016/027271 mailed Sep. 8, 2016.

International Search Report and Written Opinion from PCT/US2012/043378, mailed Dec. 17, 2012.

Reynolds et al., "Rational siRNA design for RNA interference," Nature Biotechnology, vol. 22, pp. 326-330, 2004.

Ando et al, "A decreased expression of angiopoietin-like 3 is protective against atherosclerosis in apoE-deficient mice," J. Lipid Res., vol. 44, pp. 1216-1223 (2003).

Vickers, T., et al., "Efficient Reduction of Target RNAs by Small Interfering RNA and RNase H-dependent Antisense Agents," The Journal of Biological Chemistry, Feb. 28, 2003, pp. 7108-7118, vol. 278, No. 9.

Comparative In Vitro Studies cited in Notice of Opposition to European Patent No. EP 2 723 758 B1, dated Mar. 19, 2019.

The Dharmacon Story cited in Opposition to European Patent No. EP 2 723 758 B1, dated Feb. 17, 2021.

Comparative in vitro Studies on ANGPTL3 inhibition of the top 10 ANGPTL3 sequences disclosed in U.S. Patent Publication 2005/0255487 cited in Opposition to European Patent No. EP 2 723 758 B1, dated Feb. 17, 2021.

Ambion Product Information Sheet cited in Opposition to European Patent No. EP 2 723 758 B1 dated Feb. 17, 2021.

Dharmacon Press Release cited in Opposition to European Patent No. EP 2 723 758 B1 dated Feb. 17, 2021.

Excerpt from WO 2009-082817 cited in Opposition to European Patent No. EP 2 723 758 B1 dated Feb. 17, 2021.

Excerpt from WO 2008-011431 cited in Opposition to European Patent No. EP 2 723 758 B1 dated Feb. 17, 2021.

Excerpt from WO2007056861 cited in Opposition to European Patent No. EP 2 723 758 B1 dated Feb. 17, 2021.

Zhao et al., "RNA Interference Targeting Liver Angiopoietin-Like Protein 3 Protects from Nephrotic Syndrome in a Rat Model via Amelioration of Pathologic Hypertriglyceridemia", Journal of Pharmacology and Experimental Therapeutics, vol. 376, No. 3, Feb. 19, 2021, pp. 428-435.

Wang et al., "Fenofibrate Exerts Protective Effects in Diabetic Retinopathy via Inhibition of the ANGPTL3 Pathway", Investigative Opthalmology & Visual Science, vol. 59, No. 10, Aug. 20, 2018 (Aug. 20, 2018), pp. 4210-4217.

Xu et al., "Role of angiopoietin-like 3 (ANGPTL3) in regulating plasma level of low-density lipoprotein cholesterol", Atherosclerosis, vol. 268, Sep. 21, 2017 (Sep. 21, 2017), pp. 196-206.

Ruhanen, et al., "Angiopoietin-like protein 3, an emerging cardiometabolic therapy target with systemic and cell-autonomous functions", Biochimica Et Biophysica Acta (BBA)—Molecular and Cell Biology of Lipids, Elsevier, Amsterdam, NL, vol. 1865, No. 12, Aug. 8, 2020 (Aug. 8, 2020).

Reeskamp, et al., "The next generation of triglyceride-lowering drugs : will reducing apolipoprotein C-III or angiopoietin like protein 3 reduce cardiovascular disease?", Current Opinion in Lipidology, vol. 31, No. 3, Jun. 2020 (Jun. 2020), pp. 140-146.

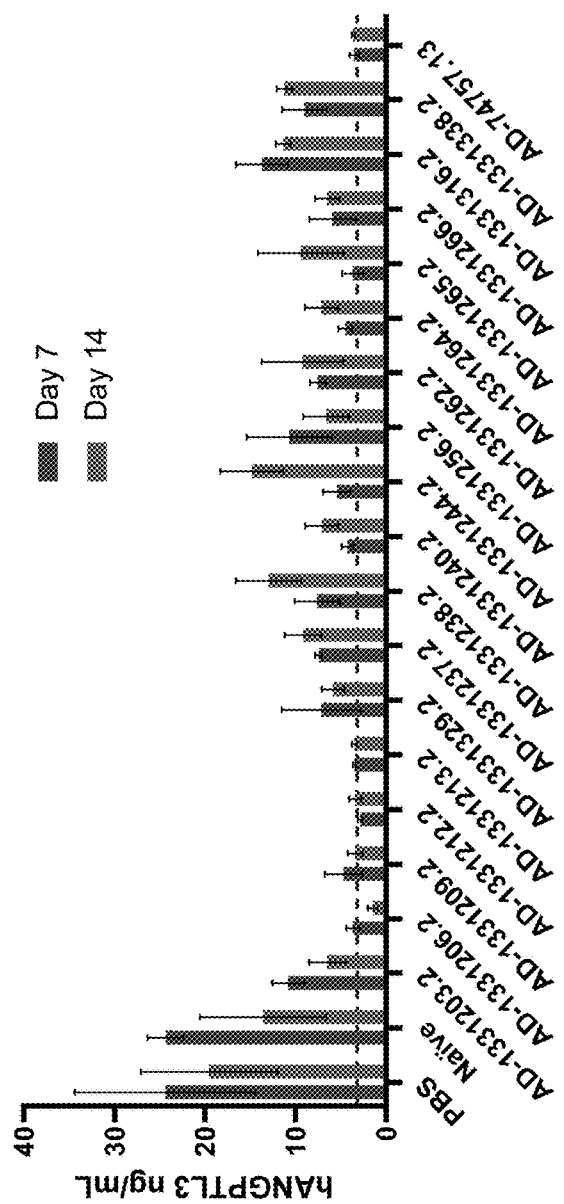
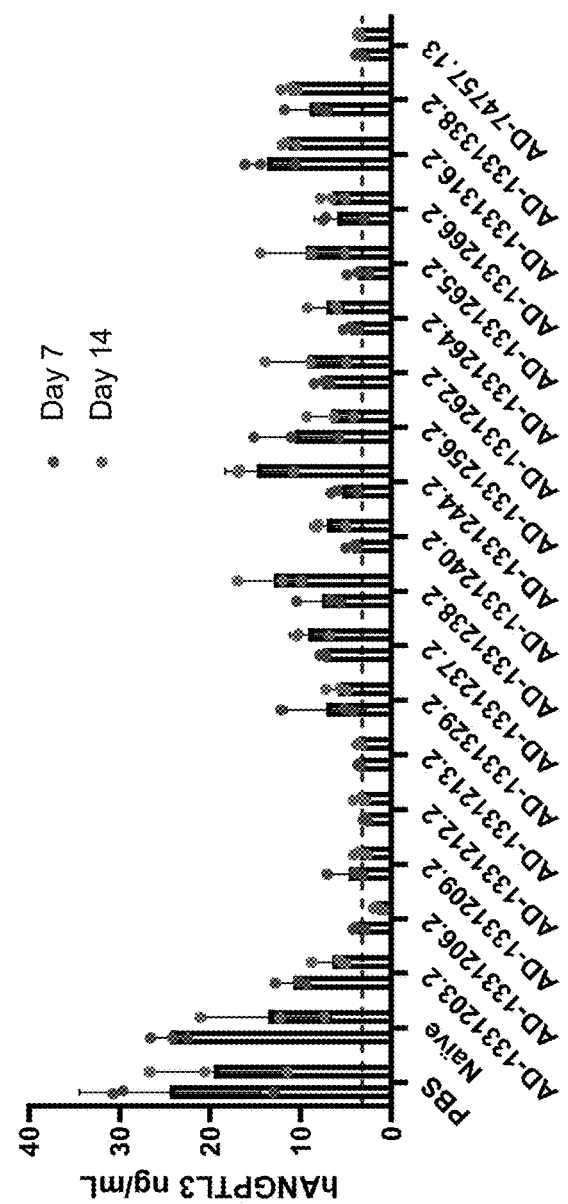
Figure 1A
Figure 1B

ANGIOPOIETIN-LIKE 3 (ANGPTL3) iRNA COMPOSITIONS AND METHODS OF USE THEREOF

RELATED APPLICATIONS

This application is a continuation of Ser. No. 17/689,034, filed on Mar. 8, 2022, which is a 35 § U.S.C. 111(a) continuation application which claims the benefit of priority to PCT/US2022/018630, filed on Mar. 3, 2022, which, in turn, claims the benefit of priority to U.S. Provisional Application No. 63/156,476, filed on Mar. 4, 2021, and U.S. Provisional Application No. 63/308,668, filed on Feb. 10, 2022. The entire contents of each of the foregoing applications are incorporated herein by reference.

SEQUENCE LISTING

The instant application contains a Sequence Listing which has been submitted electronically in XML file format and is hereby incorporated by reference in its entirety. Said XML copy, created on Jul. 28, 2022, is named 121301-15104_SL.xml and is 7,524,151 bytes in size.

BACKGROUND OF THE INVENTION

Angiopoietin-like 3 (ANGPTL3) is a member of the angiopoietin-like family of secreted factors that regulates lipid metabolism and that is predominantly expressed in the liver (Koishi, R. et al., (2002) *Nat. Genet.* 30(2):151-157). ANGPTL3 dually inhibits the catalytic activities of lipoprotein lipase (LPL), which catalyzes the hydrolysis of triglycerides, and of endothelial lipase (EL), which hydrolyzes high density lipoprotein (HDL) phospholipids. In hypolipidemic, yet obese, KK/Snk mice, a reduction in ANGPTL3 expression has a protective effect against hyperlipidemia and artherosclerosis by promoting the clearance of triglycerides (Ando et al., (2003) *J. Lipid Res.*, 44:1216-1223). Human ANGPTL3 plasma concentrations positively correlate with plasma HDL cholesterol and HDL phospholipid levels (Shimamura et al., (2007) *Arterioscler. Thromb. Vasc. Biol.*, 27:366-372).

Disorders of lipid metabolism can lead to elevated levels of serum lipids, such as triglycerides and/or cholesterol. Elevated serum lipids are strongly associated with high blood pressure, cardiovascular disease, diabetes and other pathologic conditions. Hypertriglyceridemia is an example of a lipid metabolism disorder that is characterized by high blood levels of triglycerides. It has been associated with atherosclerosis, even in the absence of high cholesterol levels (hypercholesterolemia). When triglyceride concentrations are excessive (i.e., greater than 1000 mg/dl or 12 mmol/1), hypertriglyceridemia can also lead to pancreatitis. Hyperlipidemia is another example of a lipid metabolism disorder that is characterized by elevated levels of any one or all lipids and/or lipoproteins in the blood. Current treatments for disorders of lipid metabolism, including dieting, exercise and treatment with statins and other drugs, are not always effective. Accordingly, there is a need in the art for alternative treatments for subjects having disorders of lipid metabolism.

SUMMARY OF THE INVENTION

The present invention provides iRNA compositions which affect the RNA-induced silencing complex (RISC)-mediated cleavage of RNA transcripts of a gene encoding Angiopoietin-like 3 (ANGPTL3). The ANGPTL3 gene may be within a cell, e.g., a cell within a subject, such as a human subject. The present invention also provides methods of using the iRNA compositions of the invention for inhibiting the expression of an ANGPL3 gene and/or for treating a subject who would benefit from inhibiting or reducing the expression of an ANGPL3 gene, e.g., a subject suffering or prone to suffering from a disorder of lipid metabolism, such as a subject suffering or prone to suffering from hyperlipidemia or hypertriglyceridemia.

Accordingly, in one aspect, the invention provides a double stranded ribonucleic acid (dsRNA) agent for inhibiting expression of Angiopoietin-like 3 (ANGPTL3) in a cell, wherein the dsRNA agent comprises a sense strand and an antisense strand forming a double stranded region, wherein the sense strand comprises at least 15, e.g., 15, 16, 17, 18, 19, 20, or 21, contiguous nucleotides differing by no more than 0, 1, 2, or 3 nucleotides from the nucleotide sequence of SEQ ID NO:1 and the antisense strand comprises at least 15, e.g., 15, 16, 17, 18, 19, 20, 21, 22, or 23, contiguous nucleotides differing by no more than 1, 2, or 3 nucleotides from the nucleotide sequence of SEQ ID NO:2. In one embodiment, the dsRNA agent comprises at least one thermally destabilizing nucleotide modification, e.g., an abasic modification; a mismatch with the opposing nucleotide in the duplex; a destabilizing sugar modification, a 2'-deoxy modification, an acyclic nucleotide, an unlocked nucleic acids (UNA), or a glycerol nucleic acid (GNA), e.g., the antisense strand comprises at least one thermally destabilizing nucleotide modification.

In one aspect, the present invention provides a double stranded ribonucleic acid (dsRNA) agent for inhibiting expression of Angiopoietin-like 3 (ANGPTL3) in a cell, wherein the dsRNA agent comprises a sense strand and an antisense strand forming a double stranded region, wherein the antisense strand comprises a region of complementarity to an mRNA encoding ANGPTL3, and wherein the region of complementarity comprises at least 15, e.g., 15, 16, 17, 18, 19, 20, 21, 22, or 23, contiguous nucleotides differing by no more than 3, e.g., 3, 2, 1, or 0, nucleotides from any one of the antisense nucleotide sequences in any one of Tables 2-3 and 7-8.

In another aspect, the present invention provides a double stranded ribonucleic acid (dsRNA) agent for inhibiting expression of Angiopoietin-like 3 (ANGPTL3) in a cell, wherein the dsRNA agent comprises a sense strand and an antisense strand forming a double stranded region, wherein the sense strand comprises at least 15, e.g., 15, 16, 17, 18, 19, 20, or 21, contiguous nucleotides differing by no more than three, e.g., 3, 2, 1, or 0, nucleotides from any one of the nucleotide sequence of nucleotides 58-80, 73-102, 73-124, 80-114, 91-113, 92-114, 291-320, 291-342, 307-336, 540-567, 540-589 and 545-577 of SEQ ID NO: 1, and the antisense strand comprises at least 15, e.g., 15, 16, 17, 18, 19, 20, 21, 22, or 23, contiguous nucleotides differing by no mofre than 3, e.g., 3, 2, 1, or 0, nucleotides from the corresponding nucleotide sequence of SEQ ID NO:2.

In one aspect, the present invention provides a double stranded ribonucleic acid (dsRNA) agent for inhibiting expression of Angiopoietin-like 3 (ANGPTL3) in a cell, wherein the dsRNA agent comprises a sense strand and an antisense strand forming a double stranded region, wherein the sense strand comprises at least 15, e.g., 15, 16, 17, 18, 19, 20, or 21, contiguous nucleotides differing by no more than three, e.g., 3, 2, 1, or 0, nucleotides from any one of the nucleotide sequence of nucleotides 58-80, 80-102; 84-106; 87-109; 91-113; 92-114; 186-208; 307-329; 308-330; 310-

332; 314-336; 545-567; 551-573; 553-575; 554-576; 555-577; 1133-1155; or 1140-1162 of SEQ ID NO: 1, and the antisense strand comprises at least 15, e.g., 15, 16, 17, 18, 19, 20, 21, 22, or 23, contiguous nucleotides differing by no more than 3, e.g., 3, 2, 1, or 0, nucleotides from the corresponding nucleotide sequence of SEQ ID NO:2.

In another aspect, the present invention provides a double stranded ribonucleic acid (dsRNA) agent for inhibiting expression of Angiopoietin-like 3 (ANGPTL3) in a cell, wherein the dsRNA agent comprises a sense strand and an antisense strand forming a double stranded region, wherein the sense strand comprises at least 15, e.g., 15, 16, 17, 18, 19, 20, or 21, contiguous nucleotides differing by no more than three, e.g., 3, 2, 1, or 0, nucleotides from any one of the nucleotide sequence of nucleotides 58-80, 91-113, or 92-114 of SEQ ID NO: 1, and the antisense strand comprises at least 15, e.g., 15, 16, 17, 18, 19, 20, 21, 22, or 23, contiguous nucleotides differing by no more than 3, e.g., 3, 2, 1, or 0, nucleotides from the corresponding nucleotide sequence of SEQ ID NO:2.

In one aspect, the present invention provides a double stranded ribonucleic acid (dsRNA) agent for inhibiting expression of Angiopoietin-like 3 (ANGPTL3) in a cell, wherein the dsRNA agent comprises a sense strand and an antisense strand forming a double stranded region, wherein the sense strand comprises at least 15, e.g., 15, 16, 17, 18, 19, 20, or 21, contiguous nucleotides differing by no more than three, e.g., 3, 2, 1, or 0, nucleotides from the nucleotide sequence of nucleotides 58-80 of SEQ ID NO: 1, and the antisense strand comprises at least 15, e.g., 15, 16, 17, 18, 19, 20, 21, 22, or 23, contiguous nucleotides differing by no more than 3, e.g., 3, 2, 1, or 0, nucleotides from the corresponding nucleotide sequence of SEQ ID NO:2.

In one embodiment, the antisense strand comprises at least 15, e.g., 15, 16, 17, 18, 19, 20, 21, 22, or 23, contiguous nucleotides differing by no more than three, e.g., 3, 2, 1, or 0, nucleotides from any one of the antisense strand nucleotide sequences of a duplex selected from the group consisting of AD-1331203.1; AD-1331206.1; AD-1331209.1; AD-1331212.1; AD-1331213.1; AD-1331329.1; AD-1331237.1; AD-1331238.1; AD-1331240.1; AD-1331244.1; AD-1331256.1; AD-1331262.1; AD-1331264.1; AD-1331265.1; AD-1331266.1; AD-1331316.1; AD-1331338.1; and AD-1479372.

In one embodiment, the antisense strand comprises at least 15, e.g., 15, 16, 17, 18, 19, 20, 21, 22, or 23, contiguous nucleotides differing by no more than three, e.g., 3, 2, 1, or 0, nucleotides from any one of the antisense strand nucleotide sequences of a duplex selected from the group consisting of AD-1331203.1; AD-1331206.1; AD-1331209.1; AD-1331212.1; AD-1331213.1; AD-1331329.1; AD-1331240.1; AD-1331262.1; AD-1331264.1; AD-1331265.1; AD-1331266.1; and AD-1479372.

In one embodiment, the antisense strand comprises at least 15, e.g., 15, 16, 17, 18, 19, 20, 21, 22, or 23, contiguous nucleotides differing by no more than three, e.g., 3, 2, 1, or 0, nucleotides from any one of the antisense strand nucleotide sequences of a duplex selected from the group consisting of AD-1331203.1; AD-1331206.1; AD-1331209.1; AD-1331212.1; AD-1331213.1; and AD-1479372.

In one embodiment, the antisense strand comprises at least 15, e.g., 15, 16, 17, 18, 19, 20, 21, 22, or 23, contiguous nucleotides differing by no more than three, e.g., 3, 2, 1, or 0, nucleotides from any one of the antisense strand nucleotide sequences of a duplex selected from the group consisting of AD-1331212.1; AD-1331213.1; and AD-1479372.

In one embodiment, the antisense strand comprises at least 15, e.g., 15, 16, 17, 18, 19, 20, 21, 22, or 23, contiguous nucleotides differing by no more than three, e.g., 3, 2, 1, or 0, nucleotides from the antisense strand nucleotide sequence of AD-1479372.

In one embodiment, the dsRNA agent comprises at least one modified nucleotide.

In one embodiment, substantially all of the nucleotides of the sense strand; substantially all of the nucleotides of the antisense strand comprise a modification; or substantially all of the nucleotides of the sense strand and substantially all of the nucleotides of the antisense strand comprise a modification.

In one embodiment, all of the nucleotides of the sense strand comprise a modification; all of the nucleotides of the antisense strand comprise a modification; or all of the nucleotides of the sense strand and all of the nucleotides of the antisense strand comprise a modification.

In one embodiment, at least one of the modified nucleotides is selected from the group consisting of a deoxynucleotide, a 3'-terminal deoxythimidine (dT) nucleotide, a 2'-O-methyl modified nucleotide, a 2'-fluoro modified nucleotide, a 2'-deoxy-modified nucleotide, a locked nucleotide, an unlocked nucleotide, a conformationally restricted nucleotide, a constrained ethyl nucleotide, an abasic nucleotide, a 2'-amino-modified nucleotide, a 2'-O-allyl-modified nucleotide, 2'-C-alkyl-modified nucleotide, 2'-hydroxly-modified nucleotide, a 2'-methoxyethyl modified nucleotide, a 2'-O-alkyl-modified nucleotide, a morpholino nucleotide, a phosphoramidate, a non-natural base comprising nucleotide, a tetrahydropyran modified nucleotide, a 1,5-anhydrohexitol modified nucleotide, a cyclohexenyl modified nucleotide, a nucleotide comprising a phosphorothioate group, a nucleotide comprising a methylphosphonate group, a nucleotide comprising a 5'-phosphate, a nucleotide comprising a 5'-phosphate mimic, a thermally destabilizing nucleotide, a glycol modified nucleotide (GNA), a nucleotide comprising a 2' phosphate, and a 2-O—(N-methylacetamide) modified nucleotide; and combinations thereof.

In one embodiment, the modifications on the nucleotides are selected from the group consisting of LNA, HNA, CeNA, 2'-methoxyethyl, 2'-O-alkyl, 2'-O-allyl, 2'-C-allyl, 2'-fluoro, 2'-deoxy, 2'-hydroxyl, and glycol; and combinations thereof.

In one embodiment, at least one of the modified nucleotides is selected from the group consisting of a deoxynucleotide, a 2'-O-methyl modified nucleotide, a 2'-fluoro modified nucleotide, a 2'-deoxy-modified nucleotide, a glycol modified nucleotide (GNA), e.g., Ggn, Cgn, Tgn, or Agn, a nucleotide with a 2' phosphate, e.g., G2p, C2p, A2p or U2p, and, a vinyl-phosphonate nucleotide; and combinations thereof.

In another embodiment, at least one of the modifications on the nucleotides is a thermally destabilizing nucleotide modification.

In one embodiment, the thermally destabilizing nucleotide modification is selected from the group consisting of an abasic modification; a mismatch with the opposing nucleotide in the duplex; and destabilizing sugar modification, a 2'-deoxy modification, an acyclic nucleotide, an unlocked nucleic acids (UNA), and a glycerol nucleic acid (GNA).

In some embodiments, the modified nucleotide comprises a short sequence of 3'-terminal deoxythimidine nucleotides (dT).

In some embodiments, the dsRNA agent further comprises at least one phosphorothioate internucleotide linkage. In some embodiments, the dsRNA agent comprises 6-8 phosphorothioate internucleotide linkages. In one embodiment, the phosphorothioate or methylphosphonate internucleotide linkage is at the 3'-terminus of one strand. Optionally, the strand is the antisense strand. In another embodiment, the strand is the sense strand. In a related embodiment, the phosphorothioate or methylphosphonate internucleotide linkage is at the 5'-terminus of one strand.

Optionally, the strand is the antisense strand. In another embodiment, the strand is the sense strand. In another embodiment, the phosphorothioate or methylphosphonate internucleotide linkage is at the both the 5'- and 3'-terminus of one strand. Optionally, the strand is the antisense strand. In another embodiment, the strand is the sense strand.

The double stranded region may be 19-30 nucleotide pairs in length; 19-25 nucleotide pairs in length; 19-23 nucleotide pairs in length; 23-27 nucleotide pairs in length; or 21-23 nucleotide pairs in length.

In one embodiment, each strand is independently no more than 30 nucleotides in length.

In one embodiment, the sense strand is 21 nucleotides in length and the antisense strand is 23 nucleotides in length.

The region of complementarity may be at least 17 nucleotides in length; between 19 and 23 nucleotides in length; or 19 nucleotides in length.

In one embodiment, at least one strand comprises a 3' overhang of at least 1 nucleotide. In another embodiment, at least one strand comprises a 3' overhang of at least 2 nucleotides.

In one embodiment, the dsRNA agent further comprises a ligand.

In one embodiment, the ligand is conjugated to the 3' end of the sense strand of the dsRNA agent.

In one embodiment, the ligand is an N-acetylgalactosamine (GalNAc) derivative.

In one embodiment, the ligand is one or more GalNAc derivatives attached through a monovalent, bivalent, or trivalent branched linker.

In one embodiment, the ligand is

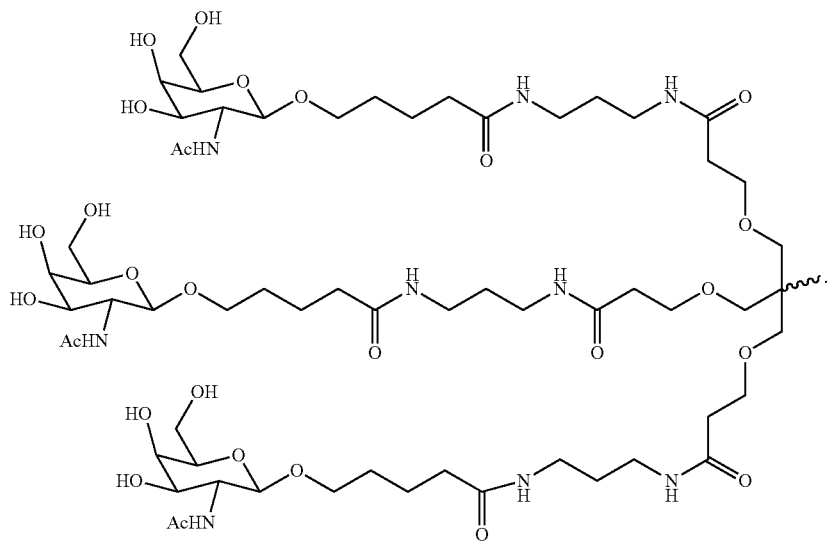 [SMILES: CC(=O)NC1C(OCCCCC(=O)NCCCNC(=O)CCOCC(C)(COCCC(=O)NCCCNC(=O)CCCCOC2OC(CO)C(O)C(O)C2NC(C)=O)COCCC(=O)NCCCNC(=O)CCCCOC2OC(CO)C(O)C(O)C2NC(C)=O)OC(CO)C(O)C1O]

In one embodiment, the dsRNA agent is conjugated to the ligand as shown in the following schematic

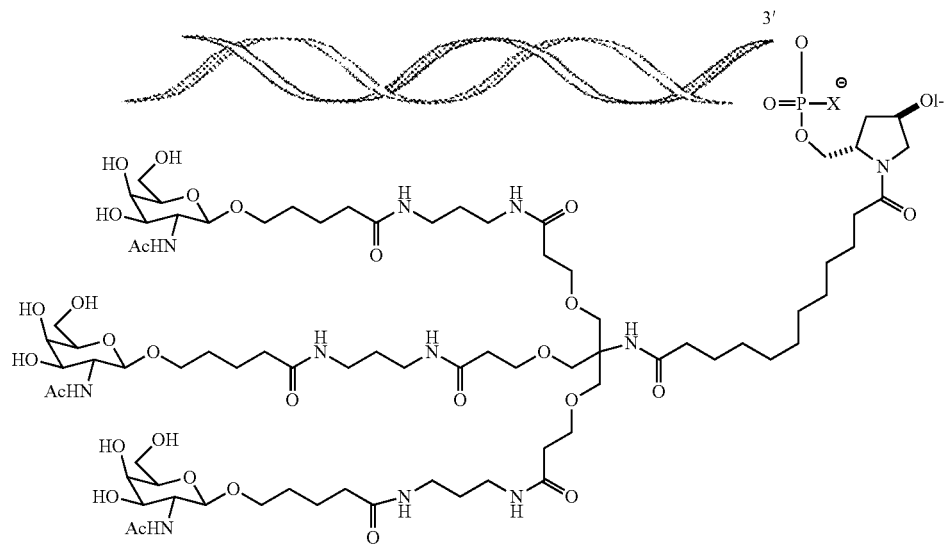

and, wherein X is O or S.

In one embodiment, the X is O.

In one embodiment, the dsRNA agent further comprises at least one phosphorothioate or methylphosphonate internucleotide linkage.

In one embodiment, the phosphorothioate or methylphosphonate internucleotide linkage is at the 3'-terminus of one strand, e.g., the antisense strand or the sense strand.

In another embodiment, the phosphorothioate or methylphosphonate internucleotide linkage is at the 5'-terminus of one strand, e.g., the antisense strand or the sense strand.

In one embodiment, the phosphorothioate or methylphosphonate internucleotide linkage is at the both the 5'- and 3'-terminus of one strand. In one embodiment, the strand is the antisense strand.

In one embodiment, the base pair at the 1 position of the 5'-end of the antisense strand of the duplex is an AU base pair.

In one embodiment, the nucleotide sequence of the sense strand differs by no more than 4 bases from the nucleotide sequence 5'-asasgcuccuUfCfUfuuuuauuguu-3' (SEQ ID NO: 18) and the nucleotide sequence of the antisense strand differs by no more than 4 bases from the nucleotide sequence 5'-asdAscadAudAaaaadGaAfggagcuusgsg-3' (SEQ ID NO: 19), wherein a, g, c and u are 2'-O-methyl (2'-OMe) A, G, C, and U; dA and dG, are 2'-deoxy A and G; Cf and Uf are 2'-deoxy-2'-fluoro (2'-F) C and U; and s is a phosphorothioate linkage.

In one embodiment, the nucleotide sequence of the sense strand differs by no more than 3 bases from the nucleotide sequence 5'-asasgcuccuUfCfUfuuuuauuguu-3' (SEQ ID NO: 18) and the nucleotide sequence of the antisense strand differs by no more than 3 bases from the nucleotide sequence 5'-asdAscadAudAaaaadGaAfggagcuusgsg-3' (SEQ ID NO: 19), wherein a, g, c and u are 2'-O-methyl (2'-OMe) A, G, C, and U; dA and dG, are 2'-deoxy A and G; Cf and Uf are 2'-deoxy-2'-fluoro (2'-F) C and U; and s is a phosphorothioate linkage.

In one embodiment, the nucleotide sequence of the sense strand differs by no more than 2 bases from the nucleotide sequence 5'-asasgcuccuUfCfUfuuuuauuguu-3' (SEQ ID NO: 18) and the nucleotide sequence of the antisense strand differs by no more than 2 bases from the nucleotide sequence 5'-asdAscadAudAaaaadGaAfggagcuusgsg-3' (SEQ ID NO: 19), wherein a, g, c and u are 2'-O-methyl (2'-OMe) A, G, C, and U; dA and dG, are 2'-deoxy A and G; Cf and Uf are 2'-deoxy-2'-fluoro (2'-F) C and U; and s is a phosphorothioate linkage.

In one embodiment, the nucleotide sequence of the sense strand differs by no more than 1 base from the nucleotide sequence 5'-asasgcuccuUfCfUfuuuuauuguu-3' (SEQ ID NO: 18) and the nucleotide sequence of the antisense strand differs by no more than 1 base from the nucleotide sequence 5'-asdAscadAudAaaaadGaAfggagcuusgsg-3' (SEQ ID NO: 19), wherein a, g, c and u are 2'-O-methyl (2'-OMe) A, G, C, and U; dA and dG, are 2'-deoxy A and G; Cf and Uf are 2'-deoxy-2'-fluoro (2'-F) C and U; and s is a phosphorothioate linkage.

In one embodiment, the nucleotide sequence of the sense strand comprises the nucleotide sequence 5'-asasgcuccuUfCfUfuuuuauuguu-3' (SEQ ID NO: 18) and the nucleotide sequence of the antisense strand comprises the nucleotide sequence 5'-asdAscadAudAaaaadGaAfggagcuusgsg-3' (SEQ ID NO: 19), wherein a, g, c and u are 2'-O-methyl (2'-OMe) A, G, C, and U; dA and dG, are 2'-deoxy A and G; Cf and Uf are 2'-deoxy-2'-fluoro (2'-F) C and U; and s is a phosphorothioate linkage.

In one embodiment, the dsRNA agent further comprises a ligand.

In one embodiment, the ligand is conjugated to the 3' end of the sense strand of the dsRNA agent.

In one embodiment, the ligand is an N-acetylgalactosamine (GalNAc) derivative.

In one embodiment, the ligand is one or more GalNAc derivatives attached through a monovalent, bivalent, or trivalent branched linker.

In one embodiment, the ligand is

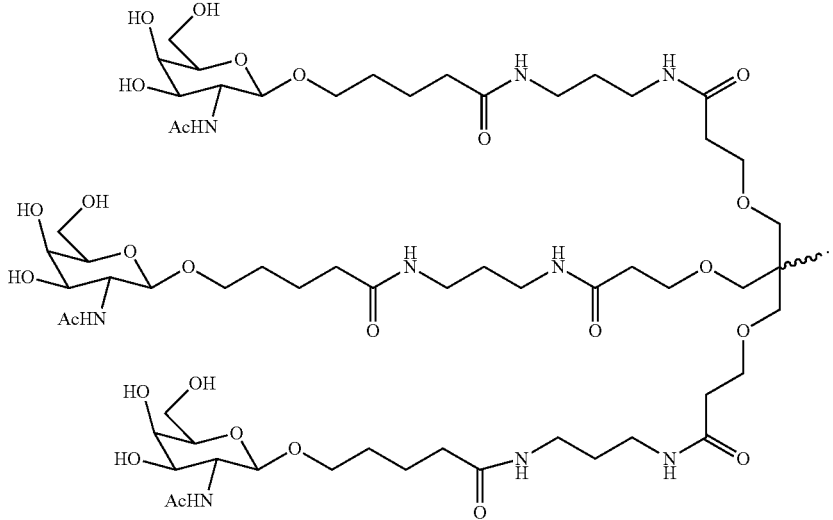 [SMILES: CC(=O)NC1C(OCCCCC(=O)NCCCNC(=O)CCOCC(C)(COCCC(=O)NCCCNC(=O)CCCCOC2OC(CO)C(O)C(O)C2NC(C)=O)COCCC(=O)NCCCNC(=O)CCCCOC2OC(CO)C(O)C(O)C2NC(C)=O)OC(CO)C(O)C1O]

and U; dA and dG, are 2'-deoxy A and G; Cf and Uf are 2'-deoxy-2'-fluoro (2'-F) C and U; and s is a phosphorothioate linkage.

In one embodiment, the nucleotide sequence of the sense strand differs by no more than 2 bases from the nucleotide sequence 5'-asasgcuccuUfCfUfuuuuauuguu-3' (SEQ ID NO: 18) and the nucleotide sequence of the antisense strand differs by no more than 2 bases from the nucleotide sequence 5'-asdAscadAudAaaaadGaAfggagcuusgsg-3' (SEQ ID NO:

In one embodiment, the nucleotide sequence of the sense strand comprises the nucleotide sequence 5'-asasgcuccuUfCfUfuuuuauuguuL96-3' (SEQ ID NO: 20) and the nucleotide sequence of the antisense strand comprises the nucleotide sequence 5'-asdAscadAudAaaaadGaAfggagcuusgsg-3' (SEQ ID NO: 19), wherein a, g, c and u are 2'-O-methyl (2'-OMe) A, G, C, and U; dA and dG, are 2'-deoxy A and G; Cf and Uf are 2'-deoxy-2'-fluoro (2'-F) C and U; s is a phosphorothioate linkage, and L96 is N-[tris(GalNAc-alkyl)-amidodecanoyl)]-4-hydroxyprolinol.

In one embodiment, the nucleotide sequence of the sense strand comprises the nucleotide sequence 5'-asasgcucuUfCfUfuuuuauuguu-3' (SEQ ID NO: 18) and the nucleotide sequence of the antisense strand comprises the nucleotide sequence 5'-asdAscadAudAaaaadGaAfggagcuusgsg-3' (SEQ ID NO: 19), wherein a, g, c and u are 2'-O-methyl (2'-OMe) A, G, C, and U; dA and dG, are 2'-deoxy A and G; Cf and Uf are 2'-deoxy-2'-fluoro (2'-F) C and U; s is a phosphorothioate linkage, and wherein a ligand is conjugated to the 3'-end of the sense strand as shown in the following schematic

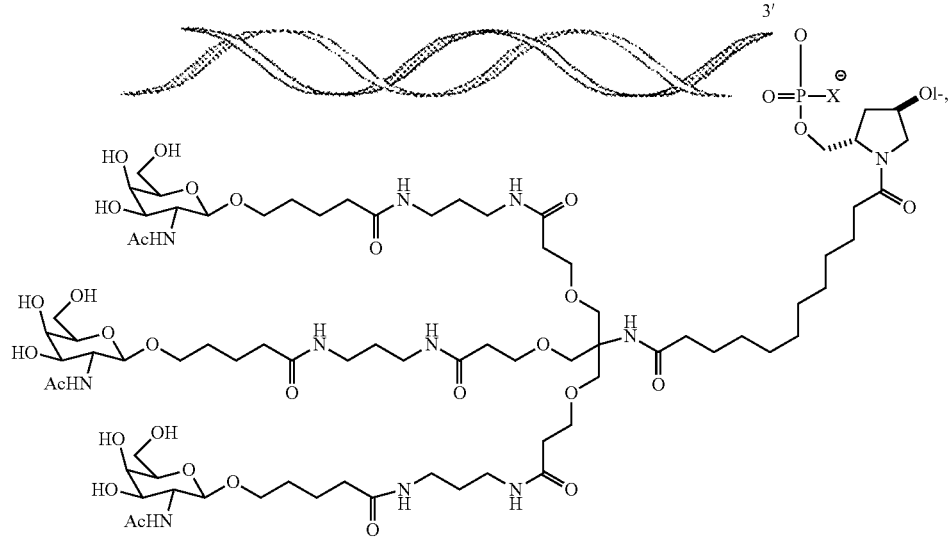

wherein X is O.

In one embodiment, the nucleotide sequence of the sense strand differs by no more than 4 bases from the nucleotide sequence 5'-asasgcucCfuUfCfUfuuuuauuguu-3' (SEQ ID NO: 21) and the nucleotide sequence of the antisense strand differs by no more than 4 bases from the nucleotide sequence 5'-asAfscaaUfaaaaagaAfgGfagcuusasa-3' (SEQ ID NO: 22); or wherein the nucleotide sequence of the sense strand differs by no more than 4 bases from the nucleotide sequence 5'-asgscuccUfuCfUfUfuuuauuguuu-3' (SEQ ID NO: 23) and the nucleotide sequence of the antisense strand differs by no more than 4 bases from the nucleotide sequence 5'-asAfsacaAfuaaaaagAfaGfgagcususa-3 (SEQ ID NO: 24), wherein a, g, c and u are 2'-O-methyl (2'-OMe) A, G, C, and U; Cf and Uf are 2'-deoxy-2'-fluoro (2'-F) C and U; and s is a phosphorothioate linkage.

In one embodiment, the nucleotide sequence of the sense strand differs by no more than 3 bases from the nucleotide sequence 5'-asasgcucCfuUfCfUfuuuuauuguu-3' (SEQ ID NO: 21) and the nucleotide sequence of the antisense strand differs by no more than 3 bases from the nucleotide sequence 5'-asAfscaaUfaaaaagaAfgGfagcuusasa-3' (SEQ ID NO: 22); or wherein the nucleotide sequence of the sense strand differs by no more than 3 bases from the nucleotide sequence 5'-asgscuccUfuCfUfUfuuuauuguuu-3' (SEQ ID NO: 23) and the nucleotide sequence of the antisense strand differs by no more than 3 bases from the nucleotide sequence 5'-asAfsacaAfuaaaaagAfaGfgagcususa-3 (SEQ ID NO: 24), wherein a, g, c and u are 2'-O-methyl (2'-OMe) A, G, C, and U; Cf and Uf are 2'-deoxy-2'-fluoro (2'-F) C and U; and s is a phosphorothioate linkage.

In one embodiment, the nucleotide sequence of the sense strand differs by no more than 2 bases from the nucleotide sequence 5'-asasgcucCfuUfCfUfuuuuauuguu-3' (SEQ ID NO: 21) and the nucleotide sequence of the antisense strand differs by no more than 2 bases from the nucleotide sequence 5'-asAfscaaUfaaaaagaAfgGfagcuusasa-3' (SEQ ID NO: 22); or wherein the nucleotide sequence of the sense strand differs by no more than 2 bases from the nucleotide sequence 5'-asgscuccUfuCfUfUfuuuauuguuu-3' (SEQ ID NO: 23) and the nucleotide sequence of the antisense strand differs by no more than 2 bases from the nucleotide sequence 5'-asAfsacaAfuaaaaagAfaGfgagcususa-3' (SEQ ID NO: 24), wherein a, g, c and u are 2'-O-methyl (2'-OMe) A, G, C, and U; Cf and Uf are 2'-deoxy-2'-fluoro (2'-F) C and U; and s is a phosphorothioate linkage.

In one embodiment, the nucleotide sequence of the sense strand differs by no more than 1 base from the nucleotide sequence 5'-asasgcucCfuUfCfUfuuuuauuguu-3' (SEQ ID NO: 21) and the nucleotide sequence of the antisense strand differs by no more than 1 base from the nucleotide sequence 5'-asAfscaaUfaaaaagaAfgGfagcuusasa-3' (SEQ ID NO: 22); or wherein the nucleotide sequence of the sense strand differs by no more than 1 base from the nucleotide sequence 5'-asgscuccUfuCfUfUfuuuauuguuu-3' (SEQ ID NO: 23) and the nucleotide sequence of the antisense strand differs by no more than 1 base from the nucleotide sequence 5'-asAfsacaAfuaaaaagAfaGfgagcususa-3 (SEQ ID NO: 24), wherein a, g, c and u are 2'-O-methyl (2'-OMe) A, G, C, and U; Cf and Uf are 2'-deoxy-2'-fluoro (2'-F) C and U; and s is a phosphorothioate linkage.

In one embodiment, the nucleotide sequence of the sense strand comprises the nucleotide sequence 5'-asasgcucCfuUfCfUfuuuuauuguu-3' (SEQ ID NO: 21) and the nucleotide sequence of the antisense strand comprises the nucleotide sequence 5'-asAfscaaUfaaaaagaAfgGfagcuusasa-3' (SEQ ID NO: 22); or wherein the nucleotide sequence of the sense strand comprises the nucleotide sequence 5'-asgscuccUfuCfUfUfuuuauuguuu-3' (SEQ ID NO: 23) and the nucleotide sequence of the antisense strand comprises the nucleotide sequence 5'-asAfsacaAfuaaaaagAfaGfgagcususa-3 (SEQ ID NO: 24), wherein a, g, c and u are 2'-O-methyl (2'-OMe) A, G, C, and U; Cf and Uf are 2'-deoxy-2'-fluoro (2'-F) C and U; s is a phosphorothioate linkage.

In one embodiment, the dsRNA agent further comprises a ligand.

In one embodiment, the ligand is conjugated to the 3' end of the sense strand of the dsRNA agent.

In one embodiment, the ligand is an N-acetylgalactosamine (GalNAc) derivative.

In one embodiment, the ligand is one or more GalNAc derivatives attached through a monovalent, bivalent, or trivalent branched linker.

In one embodiment, the ligand is

ID NO: 281) and the nucleotide sequence of the antisense strand comprises the nucleotide sequence 5'-asAfsacaAf-uaaaaagAfaGfgagcususa-3' (SEQ ID NO: 24), wherein a, g, c and u are 2'-O-methyl (2'-OMe) A, G, C, and U; Cf and Uf are 2'-deoxy-2'-fluoro (2'-F) C and U; s is a phosphorothioate linkage, and L96 is N-[tris(GalNAc-alkyl)-amidodecanoyl)]-4-hydroxyprolinol.

In one embodiment, the nucleotide sequence of the sense strand comprises the nucleotide sequence 5'-asasg-cucCfuUfCfUfuuuuauuguu-3' (SEQ ID NO: 21) and the

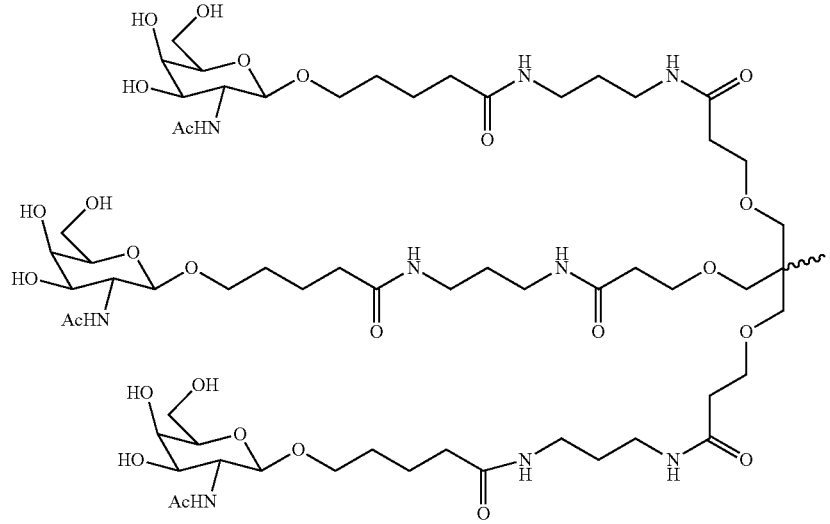

In one embodiment, the nucleotide sequence of the sense strand comprises the nucleotide sequence 5'-asasg-cucCfuUfCfUfuuuuauuguuL96-3' (SEQ ID NO: 25) and the nucleotide sequence of the antisense strand comprises the nucleotide sequence 5'-asAfscaaUfaaaaagaAfgGfagc-uusasa-3' (SEQ ID NO: 22); or wherein the nucleotide sequence of the sense strand comprises the nucleotide sequence 5'-asgscuccUfuCfUfUfuuuauuguuuL96-3' (SEQ nucleotide sequence of the antisense strand comprises the nucleotide sequence 5'-asAfscaaUfaaaaagaAfgGfagc-uusasa-3' (SEQ ID NO: 22); wherein a, g, c and u are 2'-O-methyl (2'-OMe) A, G, C, and U; Cf and Uf are 2'-deoxy-2'-fluoro (2'-F) C and U; s is a phosphorothioate linkage, and wherein a ligand is conjuagated to the 3'-end of the sense strand as shown in the following schematic

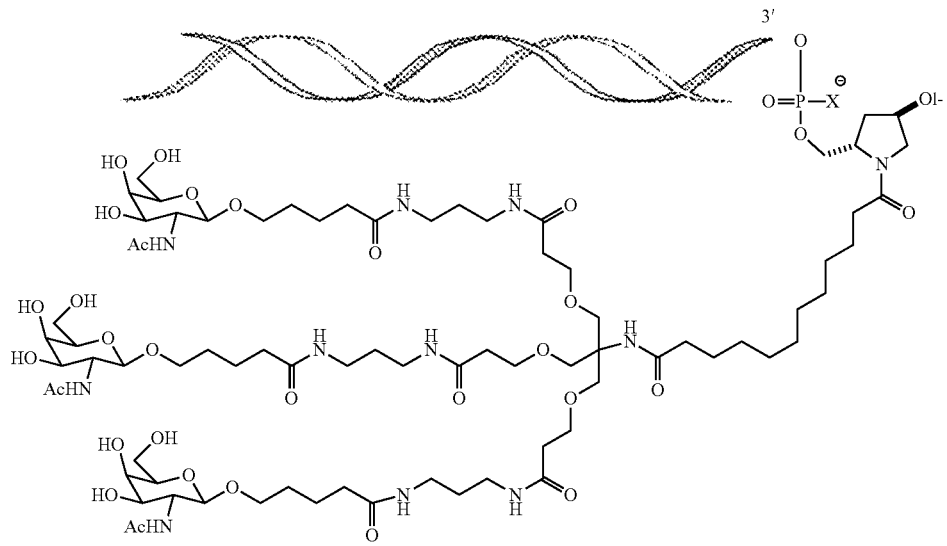

and,
  wherein X is O.

In one embodiment, the nucleotide sequence of the sense strand comprises the nucleotide sequence 5'-asgscuccU-fuCfUfUfuuuauuguuu-3' (SEQ ID NO: 23) and the nucleotide sequence of the antisense strand comprises the nucleotide sequence 5'-asAfsacaAfuaaaaagAfaGfgagcususa-3 (SEQ ID NO: 24), wherein a, g, c and u are 2'-O-methyl (2'-OMe) A, G, C, and U; Cf and Uf are 2'-deoxy-2'-fluoro (2'-F) C and U; s is a phosphorothioate linkage and wherein a ligand is conjuaged to the 3'-end of the sense strand as shown in the following schematic

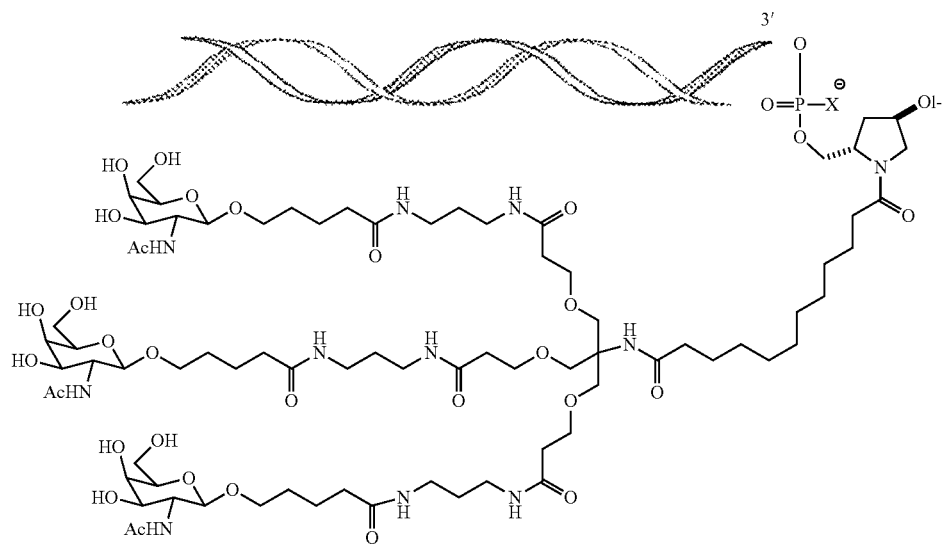

and,
  wherein X is O.

The present invention also provides cells containing any of the dsRNA agents of the invention and pharmaceutical compositions comprising any of the dsRNA agents of the invention.

The pharmaceutical composition of the invention may include dsRNA agent in an unbuffered solution, e.g., saline or water, or the pharmaceutical composition of the invention may include the dsRNA agent is in a buffer solution, e.g., a buffer solution comprising acetate, citrate, prolamine, carbonate, or phosphate or any combination thereof; or phosphate buffered saline (PBS).

In one aspect, the present invention provides a method of inhibiting expression of an Angiopoietin-like 3 (ANGPTL3) gene in a cell. The method includes contacting the cell with any of the dsRNAs of the invention or any of the pharmaceutical compositions of the invention, thereby inhibiting expression of the ANGPTL3 gene in the cell.

In one embodiment, the cell is within a subject, e.g., a human subject, e.g., a subject having an Angiopoietin-like 3 (ANGPTL3)-associated disorder, such as a disorder of lipid metabolism. In certain embodiments, the disorder of lipid metabolism is hyperlipidemia or hypertriglyceridemia.

In certain embodiments, the ANGPTL3 expression is inhibited by at least about 30%, 40%, 50%, 60%, 70%, 80%, 90%, or 95%. In one embodiment, inhibiting expression of ANGPTL3 decreases ANGPTL3 protein level in serum of the subject by at least 30%, 40%, 50%, 60%, 70%, 80%, 90%, or 95%.

In one aspect, the present invention provides a method of treating a subject having a disorder that would benefit from reduction in Angiopoietin-like 3 (ANGPTL3) expression. The method includes administering to the subject a therapeutically effective amount of any of the dsRNAs of the invention or any of the pharmaceutical compositions of the invention, thereby treating the subject having the disorder that would benefit from reduction in ANGPTL3 expression.

In another aspect, the present invention provides a method of preventing at least one symptom in a subject having a disorder that would benefit from reduction in Angiopoietin-like 3 (ANGPTL3) expression. The method includes administering to the subject a prophylactically effective amount of any of the dsRNAs of the invention or any of the pharmaceutical compositions of the invention, thereby preventing at least one symptom in the subject having the disorder that would benefit from reduction in ANGPTL3 expression.

In certain embodiments, the disorder is an Angiopoietin-like 3 (ANGPTL3)-associated disorder, e.g., a disorder of lipid metabolism. In certain embodiments, the disorder of lipid metabolism is hyperlipidemia or hypertriglyceridemia. In certain embodiments, administration of the dsRNA to the subject causes a decrease in one or more serum lipid and/or a decrease in ANGPTL3 protein accumulation.

In a further aspect, the present invention also provides methods of inhibiting the expression of ANGPTL3 in a subject. The methods include administering to the subject a therapeutically effective amount of any of the dsRNAs provided herein, thereby inhibiting the expression of ANGPTL3 in the subject.

In one embodiment, the subject is human.

In one embodiment, the dsRNA agent is administered to the subject at a dose of about 0.01 mg/kg to about 50 mg/kg.

In one embodiment, the dsRNA agent is administered to the subject subcutaneously.

In one embodiment, the methods of the invention include further determining the level of ANGPTL3 in a sample(s) from the subject.

In one embodiment, the level of ANGPTL3 in the subject sample(s) is an ANGPTL3 protein level in a blood or serum sample(s).

In certain embodiments, the methods of the invention further comprise administering to the subject an additional therapeutic agent.

The present invention also provides kits comprising any of the dsRNAs of the invention or any of the pharmaceutical compositions of the invention, and optionally, instructions for use. In one embodiment, the invention provides a kit for performing a method of inhibiting expression of ANGPTL3 gene in a cell by contacting a cell with a double stranded RNAi agent of the invention in an amount effective to inhibit expression of the ANGPTL3 in the cell. The kit comprises an RNAi agent and instructions for use and, optionally, means for administering the RNAi agent to a subject.

In one embodiment, the RNAi agent is a pharmaceutically acceptable salt thereof. "Pharmaceutically acceptable salts" of each of RNAi agents herein include, but are not limited to, a sodium salt, a calcium salt, a lithium salt, a potassium salt, an ammonium salt, a magnesium salt, an mixtures thereof. One skilled in the art will appreciate that the RNAi agent, when provided as a polycationic salt having one cation per free acid group of the optionally modified phosophodiester backbone and/or any other acidic modifications (e.g., 5'-terminal phosphonate groups). For example, an oligonucleotide of "n" nucleotides in length contains n−1 optionally modified phosophodiesters, so that an oligonucleotide of 21 nt in length may be provided as a salt having up to 20 cations (e.g, 20 sodium cations). Similarly, an RNAi agentshaving a sense strand of 21 nt in length and an antisense strand of 23 nt in length may be provided as a salt having up to 42 cations (e.g, 42 sodium cations). In the preceding example, where the RNAi agent also includes a 5'-terminal phosphate or a 5'-terminal vinylphosphonate group, the RNAi agent may be provided as a salt having up to 44 cations (e.g, 44 sodium cations).

BRIEF DESCRIPTION OF THE DRAWINGS

FIGS. 1A and 1B are graphs showing human ANGPTL3 protein levels in serum samples of mice (n=3 per group) subcutaneously administered with a single 3 mg/kg dose of the indicated dsRNA duplexes. The serum samples were collected on day 7 or day 14 post-dose. Human ANGPTL3 protein levels were determined by ELISA. FIG. 1A shows the group means with standard deviation. FIG. 1B shows the individual points with standard deviation.

DETAILED DESCRIPTION OF THE INVENTION

Figure 2:
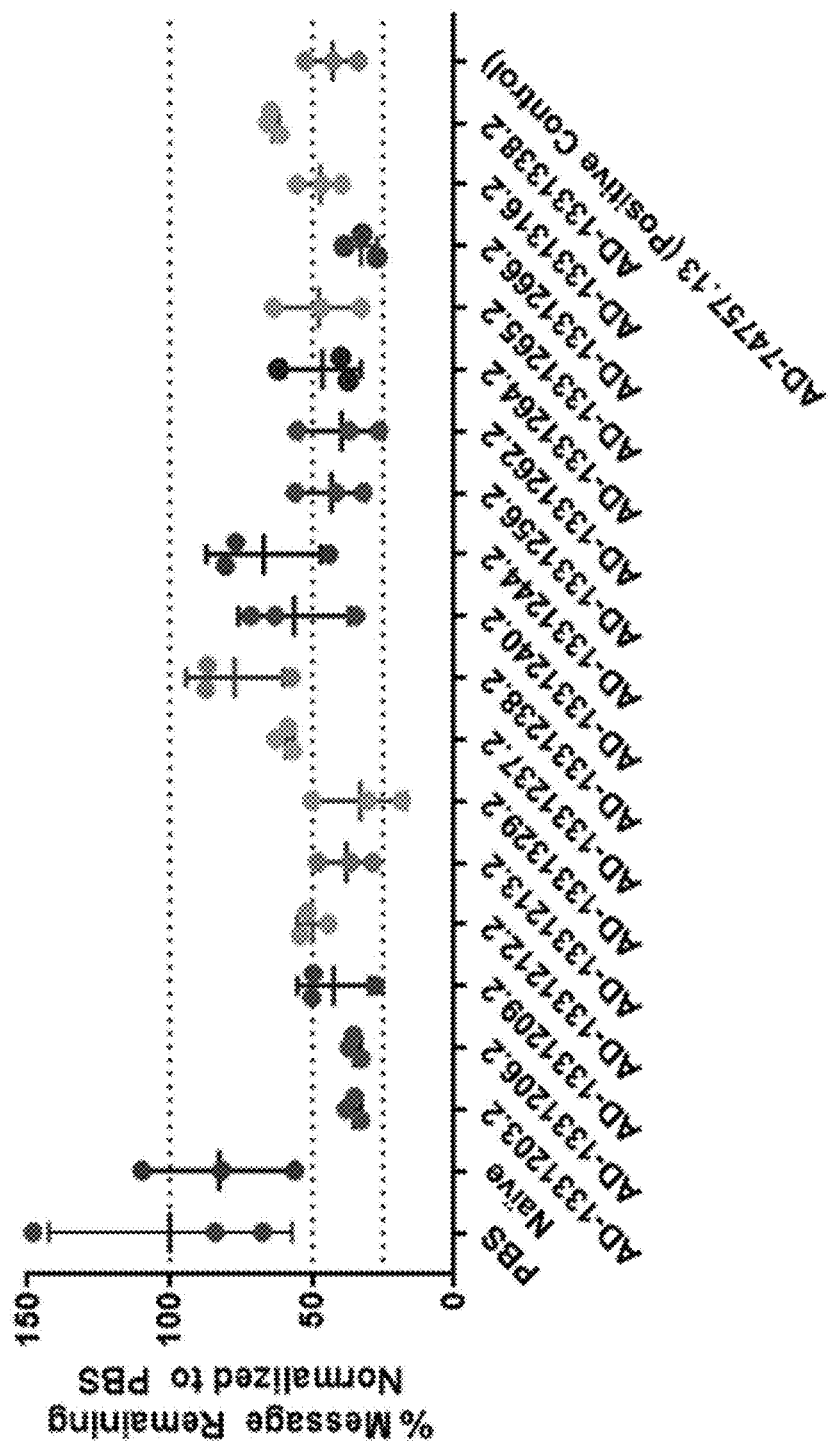
FIG. 2 is a graph showing human ANGPTL3 mRNA levels in mice (n=3 per group) subcutaneously administered a single dose of the indicated dsRNA duplexes, on day 14 post-dose. Human ANGPTL3 mRNA levels are shown relative to control levels detected with PBS treatment.

The present invention provides iRNA compositions which effect the RNA-induced silencing complex (RISC)-mediated cleavage of RNA transcripts of an Angiopoietin-like 3 (ANGPTL3) gene. The gene may be within a cell, e.g., a cell within a subject, such as a human. The use of these iRNAs enables the targeted degradation of mRNAs of the corresponding gene (ANGPTL3) in mammals.

The iRNAs of the invention have been designed to target the human Angiopoietin-like 3 (ANGPTL3) gene, including portions of the gene that are conserved in the ANGPTL3 orthologs of other mammalian species. Without intending to be limited by theory, it is believed that a combination or sub-combination of the foregoing properties and the specific target sites or the specific modifications in these iRNAs confer to the iRNAs of the invention improved efficacy, stability, potency, durability, and safety.

Accordingly, the present invention provides methods for treating and preventing an Angiopoietin-like 3 (ANGPTL3)-associated disorder, e.g., a disorder of lipid metabolism, such as hyperlipidemia or hypertriglyceridemia, using iRNA compositions which effect the RNA-induced silencing complex (RISC)-mediated cleavage of RNA transcripts of an ANGPTL3 gene.

The iRNAs of the invention include an RNA strand (the antisense strand) having a region which is up to about 30 nucleotides or less in length, e.g., 19-30, 19-29, 19-28, 19-27, 19-26, 19-25, 19-24, 19-23, 19-22, 19-21, 19-20, 20-30, 20-29, 20-28, 20-27, 20-26, 20-25, 20-24, 20-23, 20-22, 20-21, 21-30, 21-29, 21-28, 21-27, 21-26, 21-25, 21-24, 21-23, or 21-22 nucleotides in length, which region is substantially complementary to at least part of an mRNA transcript of an ANGPTL3 gene.

In certain embodiments, one or both of the strands of the double stranded RNAi agents of the invention is up to 66 nucleotides in length, e.g., 36-66, 26-36, 25-36, 31-60, 22-43, 27-53 nucleotides in length, with a region of at least 19 contiguous nucleotides that is substantially complementary to at least a part of an mRNA transcript of an ANGPTL3 gene. In some embodiments, such iRNA agents having longer length antisense strands may, for example, include a second RNA strand (the sense strand) of 20-60 nucleotides in length wherein the sense and antisense strands form a duplex of 18-30 contiguous nucleotides.

The use of iRNAs of the invention enables the targeted degradation of mRNAs of the corresponding gene (ANGPTL3 gene) in mammals Using in vitro assays, the present inventors have demonstrated that iRNAs targeting an ANGPTL3 gene can potently mediate RNAi, resulting in significant inhibition of expression of an ANGPTL3 gene. Thus, methods and compositions including these iRNAs are useful for treating a subject having an ANGPTL3-associated disorder, e.g., a disorder of lipid metabolism, such as hyperlipidemia or hypertriglyceridemia.

Accordingly, the present invention provides methods and combination therapies for treating a subject having a disorder that would benefit from inhibiting or reducing the expression of an ANGPTL3 gene, e.g., an Angiopoietin-like 3 (ANGPTL3)-associated disease, such as a disorder of lipid metabolism, e.g., hyperlipidemia or hypertriglyceridemia, using iRNA compositions which effect the RNA-induced silencing complex (RISC)-mediated cleavage of RNA transcripts of an ANGPTL3 gene.

The present invention also provides methods for preventing at least one symptom in a subject having a disorder that would benefit from inhibiting or reducing the expression of a ANGPTL3 gene, e.g., a disorder of lipid metabolism, such as hyperlipidemia or hypertriglyceridemia.

The following detailed description discloses how to make and use compositions containing iRNAs to inhibit the expression of an ANGPTL3 gene as well as compositions, uses, and methods for treating subjects that would benefit from inhibition and/or reduction of the expression of an ANGPTL3 gene, e.g., subjects susceptible to or diagnosed with an ANGPTL3-associated disorder.

I. Definitions

In order that the present invention may be more readily understood, certain terms are first defined. In addition, it should be noted that whenever a value or range of values of a parameter are recited, it is intended that values and ranges intermediate to the recited values are also intended to be part of this invention.

The articles "a" and "an" are used herein to refer to one or to more than one (i.e., to at least one) of the grammatical object of the article. By way of example, "an element" means one element or more than one element, e.g., a plurality of elements.

The term "including" is used herein to mean, and is used interchangeably with, the phrase "including but not limited to".

The term "or" is used herein to mean, and is used interchangeably with, the term "and/or," unless context clearly indicates otherwise. For example, "sense strand or antisense strand" is understood as "sense strand or antisense strand or sense strand and antisense strand."

The term "about" is used herein to mean within the typical ranges of tolerances in the art. For example, "about" can be understood as about 2 standard deviations from the mean. In certain embodiments, about means±10%. In certain embodiments, about means±5%. When about is present before a series of numbers or a range, it is understood that "about" can modify each of the numbers in the series or range.

The term "at least", "no less than", or "or more" prior to a number or series of numbers is understood to include the number adjacent to the term "at least", and all subsequent numbers or integers that could logically be included, as clear from context. For example, the number of nucleotides in a nucleic acid molecule must be an integer. For example, "at least 19 nucleotides of a 21 nucleotide nucleic acid molecule" means that 19, 20, or 21 nucleotides have the indicated property. When at least is present before a series of numbers or a range, it is understood that "at least" can modify each of the numbers in the series or range.

As used herein, "no more than" or "or less" is understood as the value adjacent to the phrase and logical lower values or integers, as logical from context, to zero. For example, a duplex with an overhang of "no more than 2 nucleotides" has a 2, 1, or 0 nucleotide overhang. When "no more than" is present before a series of numbers or a range, it is understood that "no more than" can modify each of the numbers in the series or range. As used herein, ranges include both the upper and lower limit.

As used herein, methods of detection can include determination that the amount of analyte present is below the level of detection of the method.

In the event of a conflict between an indicated target site and the nucleotide sequence for a sense or antisense strand, the indicated sequence takes precedence.

In the event of a conflict between a sequence and its indicated site on a transcript or other sequence, the nucleotide sequence recited in the specification takes precedence.

As used herein, "Angiopoietin-like 3," used interchangeably with the term "ANGPTL3," refers to the well-known gene that encodes a member of a family of secreted proteins that function in angiogenesis. The encoded protein, which is expressed predominantly in the liver, is further processed into an N-terminal coiled-coil domain-containing chain and a C-terminal fibrinogen chain. The N-terminal chain is important for lipid metabolism, while the C-terminal chain may be involved in angiogenesis. Mutations in this gene cause familial hypobetalipoproteinemia type 2.

The sequence of a human ANGPTL3 mRNA transcript can be found at, for example, GenBank Accession No. GI: 452408443 (NM_014495.3; SEQ ID NO:1; reverse complement, SEQ ID NO: 2) or GenBank Accession No. GI: 41327750 (NM_014495.2; SEQ ID NO: 3; reverse complement, SEQ ID NO: 4). The sequence of mouse ANGPTL3 mRNA can be found at, for example, GenBank Accession No. GI: 142388354 (NM_013913.3; SEQ ID NO:5; reverse complement, SEQ ID NO: 6). The sequence of rat ANGPTL3 mRNA can be found at, for example, GenBank Accession No. GI: 68163568 (NM_001025065.1; SEQ ID NO:7; reverse complement, SEQ ID NO: 8). The sequence of *Macaca fascicularis* ANGPTL3 mRNA can be found at, for example, GenBank Accession No. GI: 982227663 (XM_005543185.2; SEQ ID NO: 9; reverse complement, SEQ ID NO: 10). The sequence of *Macaca mulatta* ANGPTL3 mRNA can be found at, for example, GenBank Accession No. GI: 297278846 (XM_001086114.2; SEQ ID NO: 11; reverse complement, SEQ ID NO: 12).

Additional examples of ANGPTL3 mRNA sequences are readily available through publicly available databases, e.g., GenBank, UniProt, OMIM, and the *Macaca* genome project web site.

Further information on ANGPTL3 can be found, for example, at www.ncbi nlm nih.gov/gene/?term=ANGPTL3.

The entire contents of each of the foregoing GenBank Accession numbers and the Gene database numbers are incorporated herein by reference as of the date of filing this application.

The term ANGPTL3, as used herein, also refers to variations of the ANGPTL3 gene including variants provided in the SNP database. Numerous sequence variations within the ANGPTL3 gene have been identified and may be found at, for example, NCBI dbSNP and UniProt (see, e.g., www.ncbi nlm nih.gov/snp/?term=ANGPTL3, the entire contents of which is incorporated herein by reference as of the date of filing this application. Non-limiting examples of SNPs within the ANGPTL3 gene may be found at, NCBI dbSNP Accession Nos. rs193064039; rs192778191; rs192764027; rs192528948; rs191931953; rs191293319; rs191171206; rs191145608; rs191086880; rs191012841; or rs190255403.

As used herein, "target sequence" refers to a contiguous portion of the nucleotide sequence of an mRNA molecule formed during the transcription of an ANGPTL3 gene, including mRNA that is a product of RNA processing of a primary transcription product. In one embodiment, the target portion of the sequence will be at least long enough to serve as a substrate for iRNA-directed cleavage at or near that portion of the nucleotide sequence of an mRNA molecule formed during the transcription of an ANGPTL3 gene.

The target sequence may be from about 19-36 nucleotides in length, e.g., about 19-30 nucleotides in length. For example, the target sequence can be about 19-30 nucleotides, 19-30, 19-29, 19-28, 19-27, 19-26, 19-25, 19-24, 19-23, 19-22, 19-21, 19-20, 20-30, 20-29, 20-28, 20-27, 20-26, 20-25, 20-24, 20-23, 20-22, 20-21, 21-30, 21-29, 21-28, 21-27, 21-26, 21-25, 21-24, 21-23, or 21-22 nucleotides in length. In certain embodiments, the target sequence is 19-23 nucleotides in length, optionally 21-23 nucleotides in length. Ranges and lengths intermediate to the above recited ranges and lengths are also contemplated to be part of the disclosure.

As used herein, the term "strand comprising a sequence" refers to an oligonucleotide comprising a chain of nucleotides that is described by the sequence referred to using the standard nucleotide nomenclature.

"G," "C," "A," "T," and "U" each generally stand for a nucleotide that contains guanine, cytosine, adenine, thymidine, and uracil as a base, respectively. However, it will be understood that the term "ribonucleotide" or "nucleotide" can also refer to a modified nucleotide, as further detailed below, or a surrogate replacement moiety (see, e.g., Table 1). The skilled person is well aware that guanine, cytosine, adenine, and uracil can be replaced by other moieties without substantially altering the base pairing properties of an oligonucleotide comprising a nucleotide bearing such replacement moiety. For example, without limitation, a nucleotide comprising inosine as its base can base pair with nucleotides containing adenine, cytosine, or uracil. Hence, nucleotides containing uracil, guanine, or adenine can be replaced in the nucleotide sequences of dsRNA featured in the invention by a nucleotide containing, for example, inosine. In another example, adenine and cytosine anywhere in the oligonucleotide can be replaced with guanine and uracil, respectively to form G-U Wobble base pairing with the target mRNA. Sequences containing such replacement moieties are suitable for the compositions and methods featured in the invention.

The terms "iRNA", "RNAi agent," "iRNA agent,", "RNA interference agent" as used interchangeably herein, refer to an agent that contains RNA as that term is defined herein, and which mediates the targeted cleavage of an RNA transcript via an RNA-induced silencing complex (RISC) pathway. iRNA directs the sequence-specific degradation of mRNA through a process known as RNA interference (RNAi). The iRNA modulates, e.g., inhibits, the expression of an ANGPTL3 gene in a cell, e.g., a cell within a subject, such as a mammalian subject.

In one embodiment, an RNAi agent of the invention includes a single stranded RNA that interacts with a target RNA sequence, e.g., an ANGPTL3 target mRNA sequence, to direct the cleavage of the target RNA. Without wishing to be bound by theory it is believed that long double stranded RNA introduced into cells is broken down into siRNA by a Type III endonuclease known as Dicer (Sharp et al. (2001) *Genes Dev.* 15:485). Dicer, a ribonuclease-III-like enzyme, processes the dsRNA into 19-23 base pair short interfering RNAs with characteristic two base 3' overhangs (Bernstein, et al., (2001) *Nature* 409:363). The siRNAs are then incorporated into an RNA-induced silencing complex (RISC) where one or more helicases unwind the siRNA duplex, enabling the complementary antisense strand to guide target recognition (Nykanen, et al., (2001) *Cell* 107:309). Upon binding to the appropriate target mRNA, one or more endonucleases within the RISC cleave the target to induce silencing (Elbashir, et al., (2001) *Genes Dev.* 15:188). Thus, in one aspect the invention relates to a single stranded RNA (siRNA) generated within a cell and which promotes the formation of a RISC complex to effect silencing of the target gene, i.e., an ANGPTL3 gene. Accordingly, the term "siRNA" is also used herein to refer to an iRNA as described above.

In certain embodiments, the RNAi agent may be a single-stranded siRNA (ssRNAi) that is introduced into a cell or organism to inhibit a target mRNA. Single-stranded RNAi agents bind to the RISC endonuclease, Argonaute 2, which then cleaves the target mRNA. The single-stranded siRNAs are generally 15-30 nucleotides and are chemically modified. The design and testing of single-stranded siRNAs are described in U.S. Pat. No. 8,101,348 and in Lima et al., (2012) *Cell* 150:883-894, the entire contents of each of which are hereby incorporated herein by reference. Any of the antisense nucleotide sequences described herein may be used as a single-stranded siRNA as described herein or as chemically modified by the methods described in Lima et al., (2012) *Cell* 150:883-894.

In certain embodiments, an "iRNA" for use in the compositions, uses, and methods of the invention is a double stranded RNA and is referred to herein as a "double stranded RNA agent," "double stranded RNA (dsRNA) molecule," "dsRNA agent," or "dsRNA". The term "dsRNA", refers to a complex of ribonucleic acid molecules, having a duplex structure comprising two anti-parallel and substantially complementary nucleic acid strands, referred to as having "sense" and "antisense" orientations with respect to a target RNA, i.e., an ANGPTL3 gene. In some embodiments of the invention, a double stranded RNA (dsRNA) triggers the degradation of a target RNA, e.g., an mRNA, through a post-transcriptional gene-silencing mechanism referred to herein as RNA interference or RNAi.

In general, the majority of nucleotides of each strand of a dsRNA molecule are ribonucleotides, but as described in detail herein, each or both strands can also include one or more non-ribonucleotides, e.g., a deoxyribonucleotide or a modified nucleotide. In addition, as used in this specification, an "iRNA" may include ribonucleotides with chemical modifications; an iRNA may include substantial modifications at multiple nucleotides. As used herein, the term "modified nucleotide" refers to a nucleotide having, independently, a modified sugar moiety, a modified internucleotide linkage, or modified nucleobase, or any combination thereof. Thus, the term modified nucleotide encompasses substitutions, additions or removal of, e.g., a functional group or atom, to internucleoside linkages, sugar moieties, or nucleobases. The modifications suitable for use in the agents of the invention include all types of modifications disclosed herein or known in the art. Any such modifications, as used in a siRNA type molecule, are encompassed by "iRNA" or "RNAi agent" for the purposes of this specification and claims.

In certain embodiments of the instant disclosure, inclusion of a deoxy-nucleotide if present within an RNAi agent can be considered to constitute a modified nucleotide.

The duplex region may be of any length that permits specific degradation of a desired target RNA through a RISC pathway, and may range from about 19 to 36 base pairs in length, e.g., about 19-30 base pairs in length, for example, about 9, 10, 11, 12, 13, 14, 15, 16, 17, 18, 19, 20, 21, 22, 23, 24, 25, 26, 27, 28, 29, 30, 31, 32, 33, 34, 35, or 36 base pairs in length, such as about 19-30, 19-29, 19-28, 19-27, 19-26, 19-25, 19-24, 19-23, 19-22, 19-21, 19-20, 20-30, 20-29, 20-28, 20-27, 20-26, 20-25, 20-24, 20-23, 20-22, 20-21, 21-30, 21-29, 21-28, 21-27, 21-26, 21-25, 21-24, 21-23, or 21-22 base pairs in length. In certain embodiments, the duplex region is 19-21 base pairs in length, e.g., 21 base pairs in length. Ranges and lengths intermediate to the above recited ranges and lengths are also contemplated to be part of the disclosure.

The two strands forming the duplex structure may be different portions of one larger RNA molecule, or they may be separate RNA molecules. Where the two strands are part of one larger molecule, and therefore are connected by an uninterrupted chain of nucleotides between the 3'-end of one strand and the 5'-end of the respective other strand forming the duplex structure, the connecting RNA chain is referred to as a "hairpin loop." A hairpin loop can comprise at least one unpaired nucleotide. In some embodiments, the hairpin loop can comprise at least 2, 3, 4, 5, 6, 7, 8, 9, 10, 20, 23 or more unpaired nucleotides. In some embodiments, the hairpin loop can be 10 or fewer nucleotides. In some embodiments, the hairpin loop can be 8 or fewer unpaired nucleotides. In some embodiments, the hairpin loop can be 4-10 unpaired nucleotides. In some embodiments, the hairpin loop can be 4-8 nucleotides.

Where the two substantially complementary strands of a dsRNA are comprised by separate RNA molecules, those molecules need not be, but can be covalently connected. Where the two strands are connected covalently by means other than an uninterrupted chain of nucleotides between the 3'-end of one strand and the 5'-end of the respective other strand forming the duplex structure, the connecting structure is referred to as a "linker." The RNA strands may have the same or a different number of nucleotides. The maximum number of base pairs is the number of nucleotides in the shortest strand of the dsRNA minus any overhangs that are present in the duplex. In addition to the duplex structure, an RNAi may comprise one or more nucleotide overhangs. In one embodiment of the RNAi agent, at least one strand comprises a 3' overhang of at least 1 nucleotide. In another embodiment, at least one strand comprises a 3' overhang of at least 2 nucleotides, e.g., 2, 3, 4, 5, 6, 7, 9, 10, 11, 12, 13, 14, or 15 nucleotides. In other embodiments, at least one strand of the RNAi agent comprises a 5' overhang of at least 1 nucleotide. In certain embodiments, at least one strand comprises a 5' overhang of at least 2 nucleotides, e.g., 2, 3, 4, 5, 6, 7, 9, 10, 11, 12, 13, 14, or 15 nucleotides. In still other embodiments, both the 3' and the 5' end of one strand of the RNAi agent comprise an overhang of at least 1 nucleotide.

In certain embodiments, an iRNA agent of the invention is a dsRNA, each strand of which comprises 19-23 nucleotides, that interacts with a target RNA sequence, e.g., an ANGPTL3 gene, to direct cleavage of the target RNA.

In some embodiments, an iRNA of the invention is a dsRNA of 24-30 nucleotides that interacts with a target RNA sequence, e.g., an ANGPTL3 target mRNA sequence, to direct the cleavage of the target RNA.

As used herein, the term "nucleotide overhang" refers to at least one unpaired nucleotide that protrudes from the duplex structure of a double stranded iRNA. For example, when a 3'-end of one strand of a dsRNA extends beyond the 5'-end of the other strand, or vice versa, there is a nucleotide overhang. A dsRNA can comprise an overhang of at least one nucleotide; alternatively the overhang can comprise at least two nucleotides, at least three nucleotides, at least four nucleotides, at least five nucleotides or more. A nucleotide overhang can comprise or consist of a nucleotide/nucleoside analog, including a deoxynucleotide/nucleoside. The overhang(s) can be on the sense strand, the antisense strand, or any combination thereof. Furthermore, the nucleotide(s) of an overhang can be present on the 5'-end, 3'-end, or both ends of either an antisense or sense strand of a dsRNA.

In one embodiment, the antisense strand of a dsRNA has a 1-10 nucleotide, e.g., a 1, 2, 3, 4, 5, 6, 7, 8, 9, or 10 nucleotide, overhang at the 3'-end or the 5'-end. In one embodiment, the sense strand of a dsRNA has a 1-10 nucleotide, e.g., a 1, 2, 3, 4, 5, 6, 7, 8, 9, or 10 nucleotide, overhang at the 3'-end or the 5'-end. In another embodiment, one or more of the nucleotides in the overhang is replaced with a nucleoside thiophosphate.

In certain embodiments, the antisense strand of a dsRNA has a 1-10 nucleotide, e.g., 0-3, 1-3, 2-4, 2-5, 4-10, 5-10, e.g., a 1, 2, 3, 4, 5, 6, 7, 8, 9, or 10 nucleotide, overhang at the 3'-end or the 5'-end. In one embodiment, the sense strand of a dsRNA has a 1-10 nucleotide, e.g., a 1, 2, 3, 4, 5, 6, 7, 8, 9, or 10 nucleotide, overhang at the 3'-end or the 5'-end. In another embodiment, one or more of the nucleotides in the overhang is replaced with a nucleoside thiophosphate.

In certain embodiments, the antisense strand of a dsRNA has a 1-10 nucleotides, e.g., a 1, 2, 3, 4, 5, 6, 7, 8, 9, or 10 nucleotide, overhang at the 3'-end or the 5'-end. In certain embodiments, the overhang on the sense strand or the antisense strand, or both, can include extended lengths longer than 10 nucleotides, e.g., 1-30 nucleotides, 2-30 nucleotides, 10-30 nucleotides, 10-25 nucleotides, 10-20 nucleotides, or 10-15 nucleotides in length. In certain embodiments, an extended overhang is on the sense strand of the duplex. In certain embodiments, an extended overhang is present on the 3' end of the sense strand of the duplex. In certain embodiments, an extended overhang is present on the 5' end of the sense strand of the duplex. In certain embodiments, an extended overhang is on the antisense strand of the duplex. In certain embodiments, an extended overhang is present on the 3' end of the antisense strand of the duplex. In certain embodiments, an extended overhang is present on the 5' end of the antisense strand of the duplex. In certain embodiments, one or more of the nucleotides in the extended overhang is replaced with a nucleoside thiophosphate. In certain embodiments, the overhang includes a self-complementary portion such that the overhang is capable of forming a hairpin structure that is stable under physiological conditions.

"Blunt" or "blunt end" means that there are no unpaired nucleotides at that end of the double stranded RNA agent, i.e., no nucleotide overhang. A "blunt ended" double stranded RNA agent is double stranded over its entire length, i.e., no nucleotide overhang at either end of the molecule. The RNAi agents of the invention include RNAi agents with no nucleotide overhang at one end (i.e., agents with one overhang and one blunt end) or with no nucleotide overhangs at either end. Most often such a molecule will be double-stranded over its entire length.

The term "antisense strand" or "guide strand" refers to the strand of an iRNA, e.g., a dsRNA, which includes a region that is substantially complementary to a target sequence, e.g., an ANGPTL3 mRNA.

As used herein, the term "region of complementarity" refers to the region on the antisense strand that is substantially complementary to a sequence, for example a target sequence, e.g., an ANGPTL3 nucleotide sequence, as defined herein. Where the region of complementarity is not fully complementary to the target sequence, the mismatches can be in the internal or terminal regions of the molecule. Generally, the most tolerated mismatches are in the terminal regions, e.g., within 5, 4, or 3 nucleotides of the 5'- or 3'-end of the iRNA. In some embodiments, a double stranded RNA agent of the invention includes a nucleotide mismatch in the antisense strand. In some embodiments, the antisense strand of the double stranded RNA agent of the invention includes no more than 4 mismatches with the target mRNA, e.g., the antisense strand includes 4, 3, 2, 1, or 0 mismatches with the target mRNA. In some embodiments, the antisense strand double stranded RNA agent of the invention includes no more than 4 mismatches with the sense strand, e.g., the antisense strand includes 4, 3, 2, 1, or 0 mismatches with the sense strand. In some embodiments, a double stranded RNA agent of the invention includes a nucleotide mismatch in the sense strand. In some embodiments, the sense strand of the double stranded RNA agent of the invention includes no more than 4 mismatches with the antisense strand, e.g., the sense strand includes 4, 3, 2, 1, or 0 mismatches with the antisense strand. In some embodiments, the nucleotide mismatch is, for example, within 5, 4, 3 nucleotides from the 3'-end of the iRNA. In another embodiment, the nucleotide mismatch is, for example, in the 3'-terminal nucleotide of the iRNA agent. In some embodiments, the mismatch(s) is not in the seed region.

Thus, an RNAi agent as described herein can contain one or more mismatches to the target sequence. In one embodiment, an RNAi agent as described herein contains no more than 3 mismatches (i.e., 3, 2, 1, or 0 mismatches). In one embodiment, an RNAi agent as described herein contains no more than 2 mismatches. In one embodiment, an RNAi agent as described herein contains no more than 1 mismatch. In one embodiment, an RNAi agent as described herein contains 0 mismatches. In certain embodiments, if the antisense strand of the RNAi agent contains mismatches to the target sequence, the mismatch can optionally be restricted to be within the last 5 nucleotides from either the 5'- or 3'-end of the region of complementarity. For example, in such embodiments, for a 23 nucleotide RNAi agent, the strand which is complementary to a region of an ANGPTL3 gene, generally does not contain any mismatch within the central 13 nucleotides. The methods described herein or methods known in the art can be used to determine whether an RNAi agent containing a mismatch to a target sequence is effective in inhibiting the expression of an ANGPTL3 gene. Consideration of the efficacy of RNAi agents with mismatches in inhibiting expression of an ANGPTL3 gene is important, especially if the particular region of complementarity in an ANGPTL3 gene is known to have polymorphic sequence variation within the population.

The term "sense strand" or "passenger strand" as used herein, refers to the strand of an iRNA that includes a region that is substantially complementary to a region of the antisense strand as that term is defined herein.

As used herein, "substantially all of the nucleotides are modified" are largely but not wholly modified and can include not more than 5, 4, 3, 2, or 1 unmodified nucleotides.

As used herein, the term "cleavage region" refers to a region that is located immediately adjacent to the cleavage site. The cleavage site is the site on the target at which cleavage occurs. In some embodiments, the cleavage region comprises three bases on either end of, and immediately adjacent to, the cleavage site. In some embodiments, the cleavage region comprises two bases on either end of, and immediately adjacent to, the cleavage site. In some embodiments, the cleavage site specifically occurs at the site bound by nucleotides 10 and 11 of the antisense strand, and the cleavage region comprises nucleotides 11, 12 and 13.

As used herein, and unless otherwise indicated, the term "complementary," when used to describe a first nucleotide sequence in relation to a second nucleotide sequence, refers to the ability of an oligonucleotide or polynucleotide comprising the first nucleotide sequence to hybridize and form a duplex structure under certain conditions with an oligonucleotide or polynucleotide comprising the second nucleotide sequence, as will be understood by the skilled person. Such conditions can, for example, be stringent conditions, where stringent conditions can include: 400 mM NaCl, 40 mM PIPES pH 6.4, 1 mM EDTA, 50° C. or 70° C. for 12-16 hours followed by washing (see, e.g., "Molecular Cloning: A Laboratory Manual, Sambrook, et al. (1989) Cold Spring Harbor Laboratory Press). Other conditions, such as physiologically relevant conditions as can be encountered inside an organism, can apply. The skilled person will be able to determine the set of conditions most appropriate for a test of complementarity of two sequences in accordance with the ultimate application of the hybridized nucleotides.

Complementary sequences within an iRNA, e.g., within a dsRNA as described herein, include base-pairing of the oligonucleotide or polynucleotide comprising a first nucleotide sequence to an oligonucleotide or polynucleotide comprising a second nucleotide sequence over the entire length of one or both nucleotide sequences. Such sequences can be referred to as "fully complementary" with respect to each other herein. However, where a first sequence is referred to as "substantially complementary" with respect to a second sequence herein, the two sequences can be fully complementary, or they can form one or more, but generally not more than 5, 4, 3, or 2 mismatched base pairs upon hybridization for a duplex up to 30 base pairs, while retaining the ability to hybridize under the conditions most relevant to their ultimate application, e.g., inhibition of gene expression, in vitro or in vivo. However, where two oligonucleotides are designed to form, upon hybridization, one or more single stranded overhangs, such overhangs shall not be regarded as mismatches with regard to the determination of complementarity. For example, a dsRNA comprising one oligonucleotide 21 nucleotides in length and another oligonucleotide 23 nucleotides in length, wherein the longer oligonucleotide comprises a sequence of 21 nucleotides that is fully complementary to the shorter oligonucleotide, can yet be referred to as "fully complementary" for the purposes described herein.

"Complementary" sequences, as used herein, can also include, or be formed entirely from, non-Watson-Crick base pairs or base pairs formed from non-natural and modified nucleotides, in so far as the above requirements with respect to their ability to hybridize are fulfilled. Such non-Watson-Crick base pairs include, but are not limited to, G:U Wobble or Hoogsteen base pairing.

The terms "complementary," "fully complementary" and "substantially complementary" herein can be used with respect to the base matching between the sense strand and the antisense strand of a dsRNA, or between two oligonucleotides or polynucleotides, such as the antisense strand of a double stranded RNA agent and a target sequence, as will be understood from the context of their use.

As used herein, a polynucleotide that is "substantially complementary to at least part of" a messenger RNA (mRNA) refers to a polynucleotide that is substantially complementary to a contiguous portion of the mRNA of interest (e.g., an mRNA encoding an ANGPTL3 gene). For example, a polynucleotide is complementary to at least a part of an ANGPTL3 mRNA if the sequence is substantially complementary to a non-interrupted portion of an mRNA encoding an ANGPTL3 gene.

Accordingly, in some embodiments, the antisense polynucleotides disclosed herein are fully complementary to the target ANGPTL3 sequence. In other embodiments, the antisense polynucleotides disclosed herein are substantially complementary to the target ANGPTL3 sequence and comprise a contiguous nucleotide sequence which is at least 80% complementary over its entire length to the equivalent region of the nucleotide sequence of any one of SEQ ID NOs:1, 3, 5, 7, 9, or 11, or a fragment of any one of SEQ ID NOs:1, 3, 5, 7, 9, or 11, such as about 85%, about 90%, about 91%, about 92%, about 93%, about 94%, about 95%, about 96%, about 97%, about 98%, or about 99% complementary.

In some embodiments, the antisense polynucleotides disclosed herein are substantially complementary to a fragment of a target ANGPTL3 sequence and comprise a contiguous nucleotide sequence which is at least 80% complementary over its entire length to a fragment of SEQ ID NO: 1 selected from the group of nucleotides 73-102, 73-124, 80-114, 291-320, 291-342, 307-336, 540-567, 540-589 and 545-577 of SEQ ID NO: 1, such as about 85%, about 90%, about 91%, about 92%, about 93%, about 94%, about 95%, about 96%, about 97%, about 98%, or about 99% complementary.

In some embodiments, the antisense polynucleotides disclosed herein are substantially complementary to a fragment of a target ANGPTL3 sequence and comprise a contiguous nucleotide sequence which is at least 80% complementary over its entire length to a fragment of SEQ ID NO: 1 selected from the group of nucleotides 80-102; 84-106; 87-109; 91-113; 92-114; 186-208; 307-329; 308-330; 310-332; 314-336; 545-567; 551-573; 553-575; 554-576; 555-577; 1133-1155; or 1140-1162 of SEQ ID NO: 1, such as about 85%, about 90%, about 91%, about 92%, about 93%, about 94%, about 95%, about 96%, about 97%, about 98%, or about 99% complementary.

In other embodiments, the antisense polynucleotides disclosed herein are substantially complementary to the target ANGPTL3 sequence and comprise a contiguous nucleotide sequence which is at least about 80% complementary over its entire length to any one of the sense strand nucleotide sequences in any one of any one of Tables 2-3 and 7-8, or a fragment of any one of the sense strand nucleotide sequences in any one of Tables 2-3 and 7-8, such as about 85%, about 90%, about 91%, about 92%, about 93%, about 94%, about 95%, about 96%, about 97%, about 98%, about 99%, or 100% complementary.

In one embodiment, an RNAi agent of the disclosure includes a sense strand that is substantially complementary to an antisense polynucleotide which, in turn, is the same as a target ANGPTL3 sequence, and wherein the sense strand polynucleotide comprises a contiguous nucleotide sequence which is at least about 80% complementary over its entire length to the equivalent region of the nucleotide sequence of SEQ ID NOs: 2, 4, 6, 8, 10, or 12, or a fragment of any one of SEQ ID NOs:2, 4, 6, 8, 10, or 12, such as about 85%, about 90%, about 91%, about 92%, about 93%, about 94%, about 95%, about 96%, about 97%, about 98%, about 99%, or 100% complementary.

In some embodiments, an iRNA of the invention includes a sense strand that is substantially complementary to an antisense polynucleotide which, in turn, is complementary to a target ANGPTL3 sequence, and wherein the sense strand polynucleotide comprises a contiguous nucleotide sequence which is at least about 80% complementary over its entire length to any one of the antisense strand nucleotide sequences in any one of any one of Tables 2-3 and 7-8, or a fragment of any one of the antisense strand nucleotide sequences in any one of Tables 2-3 and 7-8, such as about 85%, about 90%, about 91%, about 92%, about 93%, about 94%, about 95%, about 96%, about 97%, about 98%, about 99%, or 100% complementary.

In one embodiment, the antisense strand comprises at least 15, e.g., 15, 16, 17, 18, 19, or 20, contiguous nucleotides differing by no more than 0, 1, 2, or 3 nucleotides from any one of the antisense strand nucleotide sequences of a duplex selected from the group consisting of AD-1331203.1; AD-1331206.1; AD-1331209.1; AD-1331212.1; AD-1331213.1; AD-1331329.1; AD-1331237.1; AD-1331238.1; AD-1331240.1; AD-1331244.1; AD-1331256.1; AD-1331262.1; AD-1331264.1; AD-1331265.1; AD-1331266.1; AD-1331316.1; and AD-1331338.1.

In one embodiment, the antisense strand comprises at least 15, e.g., 15, 16, 17, 18, 19, or 20, contiguous nucleotides differing by no more than 0, 1, 2, or 3 nucleotides from any one of the antisense strand nucleotide sequences of a duplex selected from the group consisting of AD-1331203.1; AD-1331206.1; AD-1331209.1; AD-1331212.1; AD-1331213.1; AD-1331329.1; AD-1331240.1; AD-1331262.1; AD-1331264.1; AD-1331265.1 and AD-1331266.1. In one embodiment, the antisense strand comprises at least 15, e.g., 15, 16, 17, 18, 19, or 20, contiguous nucleotides differing by no more than 0, 1, 2, or 3 nucleotides from any one of the antisense strand nucleotide sequences of a duplex selected from the group consisting of AD-1331203.1; AD-1331206.1; AD-1331209.1; AD-1331212.1; AD-1331213.1.

In general, an "iRNA" includes ribonucleotides with chemical modifications. Such modifications may include all types of modifications disclosed herein or known in the art. Any such modifications, as used in a dsRNA molecule, are encompassed by "iRNA" for the purposes of this specification and claims.

In certain embodiments of the instant disclosure, inclusion of a deoxy-nucleotide if present within an RNAi agent can be considered to constitute a modified nucleotide.

In an aspect of the invention, an agent for use in the methods and compositions of the invention is a single-stranded antisense oligonucleotide molecule that inhibits a target mRNA via an antisense inhibition mechanism. The single-stranded antisense oligonucleotide molecule is complementary to a sequence within the target mRNA. The single-stranded antisense oligonucleotides can inhibit translation in a stoichiometric manner by base pairing to the mRNA and physically obstructing the translation machinery, see Dias, N. et al., (2002) *Mol Cancer Ther* 1:347-355. The single-stranded antisense oligonucleotide molecule may be about 14 to about 30 nucleotides in length and have a sequence that is complementary to a target sequence. For example, the single-stranded antisense oligonucleotide molecule may comprise a sequence that is at least about 14, 15, 16, 17, 18, 19, 20, or more contiguous nucleotides from any one of the antisense sequences described herein.

The phrase "contacting a cell with an iRNA," such as a dsRNA, as used herein, includes contacting a cell by any possible means. Contacting a cell with an iRNA includes contacting a cell in vitro with the iRNA or contacting a cell in vivo with the iRNA. The contacting may be done directly or indirectly. Thus, for example, the iRNA may be put into physical contact with the cell by the individual performing the method, or alternatively, the iRNA may be put into a situation that will permit or cause it to subsequently come into contact with the cell.

Contacting a cell in vitro may be done, for example, by incubating the cell with the iRNA. Contacting a cell in vivo may be done, for example, by injecting the iRNA into or near the tissue where the cell is located, or by injecting the iRNA into another area, e.g., the bloodstream or the subcutaneous space, such that the agent will subsequently reach the tissue where the cell to be contacted is located. For example, the iRNA may contain or be coupled to a ligand, e.g., GalNAc, that directs the iRNA to a site of interest, e.g., the liver. Combinations of in vitro and in vivo methods of contacting are also possible. For example, a cell may also be contacted in vitro with an iRNA and subsequently transplanted into a subject.

In certain embodiments, contacting a cell with an iRNA includes "introducing" or "delivering the iRNA into the cell" by facilitating or effecting uptake or absorption into the cell. Absorption or uptake of an iRNA can occur through unaided diffusion or active cellular processes, or by auxiliary agents or devices. Introducing an iRNA into a cell may be in vitro or in vivo. For example, for in vivo introduction, iRNA can be injected into a tissue site or administered systemically. In vitro introduction into a cell includes methods known in the art such as electroporation and lipofection. Further approaches are described herein below or are known in the art.

The term "lipid nanoparticle" or "LNP" is a vesicle comprising a lipid layer encapsulating a pharmaceutically active molecule, such as a nucleic acid molecule, e.g., an iRNA or a plasmid from which an iRNA is transcribed. LNPs are described in, for example, U.S. Pat. Nos. 6,858,225, 6,815,432, 8,158,601, and 8,058,069, the entire contents of which are hereby incorporated herein by reference.

As used herein, a "subject" is an animal, such as a mammal, including a primate (such as a human, a non-human primate, e.g., a monkey, and a chimpanzee), a non-primate (such as a cow, a pig, a horse, a goat, a rabbit, a sheep, a hamster, a guinea pig, a cat, a dog, a rat, or a mouse), or a bird that expresses the target gene, either endogenously or heterologously. In an embodiment, the subject is a human, such as a human being treated or assessed for a disease or disorder that would benefit from reduction in ANGPTL3 expression; a human at risk for a disease or disorder that would benefit from reduction in ANGPTL3 expression; a human having a disease or disorder that would benefit from reduction in ANGPTL3 expression; or human being treated for a disease or disorder that would benefit from reduction in ANGPTL3 expression as described herein. In some embodiments, the subject is a female human. In other embodiments, the subject is a male human. In one embodiment, the subject is an adult subject. In another embodiment, the subject is a pediatric subject.

As used herein, the terms "treating" or "treatment" refer to a beneficial or desired result, such as reducing at least one sign or symptom of an ANGPTL3-associated disorder in a subject. Treatment also includes a reduction of one or more sign or symptoms associated with unwanted ANGPTL3 expression; diminishing the extent of unwanted ANGPTL3 activation or stabilization; amelioration or palliation of unwanted ANGPTL3 activation or stabilization. "Treatment" can also mean prolonging survival as compared to expected survival in the absence of treatment. The term "lower" in the context of the level of ANGPTL3 in a subject or a disease marker or symptom refers to a statistically significant decrease in such level. The decrease can be, for example, at least 10%, 15%, 20%, 25%, 30%, %, 40%, 45%, 50%, 55%, 60%, 65%, 70%, 75%, 80%, 85%, 90%, 95%, or more. In certain embodiments, a decrease is at least 20%. In certain embodiments, the decrease is at least 50% in a disease marker, e.g., protein or gene expression level. "Lower" in the context of the level of ANGPTL3 in a subject is a decrease to a level accepted as within the range of normal for an individual without such disorder. In certain embodiments, "lower" is the decrease in the difference between the level of a marker or symptom for a subject suffering from a disease and a level accepted within the range of normal for an individual, e.g., the level of decrease in bodyweight between an obese individual and an individual having a weight accepted within the range of normal.

As used herein, "prevention" or "preventing," when used in reference to a disease, disorder or condition thereof, may be treated or ameliorated by a reduction in expression of an ANGPTL3 gene, refers to a reduction in the likelihood that a subject will develop a symptom associated with such a disease, disorder, or condition, e.g., a symptom of unwanted or excessive ANGPTL3 expression, such as high triglyceride levels or eruptive xanthoma. The likelihood of developing high triglyceride levels or eruptive xanthoma is reduced, for example, when an individual having one or more risk factors for high triglyceride levels or eruptive xanthoma either fails to develop high triglyceride levels or eruptive xanthoma, or develops high triglyceride levels or eruptive xanthoma with less severity relative to a population having the same risk factors and not receiving treatment as described herein. The failure to develop a disease, disorder or condition, or the reduction in the development of a symptom associated with such a disease, disorder or condition (e.g., by at least about 10% on a clinically accepted scale for that disease or disorder), or the exhibition of delayed symptoms delayed (e.g., by days, weeks, months or years) is considered effective prevention.

As used herein, the term "serum lipid" refers to any major lipid present in the blood. Serum lipids may be present in the blood either in free form or as a part of a protein complex, e.g., a lipoprotein complex. Non-limiting examples of serum lipids may include triglycerides and cholesterol, such as total cholesterol (TG), low density lipoprotein cholesterol (LDL-C), high-density lipoprotein cholesterol (HDL-C), very low density lipoprotein cholesterol (VLDL-C) and intermediate-density lipoprotein cholesterol (IDL-C).

As used herein, the term "Angiopoietin-like 3-associated disease" or "ANGPTL3-associated disease," is a disease or disorder that is caused by, or associated with ANGPTL3 gene expression or ANGPTL3 protein production. The term "ANGPTL3-associated disease" includes a disease, disorder or condition that would benefit from a decrease in ANGPTL3 gene expression, replication, or protein activity. In some embodiments, the ANGPTL3-associated disease is a disorder of lipid metabolism.

As used herein, a "disorder of lipid metabolism" refers to any disorder associated with or caused by a disturbance in lipid metabolism. For example, this term includes any disorder, disease or condition that can lead to hyperlipidemia, or condition characterized by abnormal elevation of levels of any or all lipids and/or lipoproteins in the blood. This term refers to an inherited disorder, such as familial hypertriglyceridemia, familial partial lipodystrophy type 1 (FPLD1), or an induced or acquired disorder, such as a disorder induced or acquired as a result of a disease, disorder or condition (e.g., renal failure), a diet, or intake of certain drugs (e.g., as a result of highly active antiretroviral therapy (HAART) used for treating, e.g., AIDS or HIV). Exemplary disorders of lipid metabolism include, but are not limited to, atherosclerosis, dyslipidemia, hypertriglyceridemia (including drug-induced hypertriglyceridemia, diuretic-induced hypertriglyceridemia, alcohol-induced hypertriglyceridemia, β-adrenergic blocking agent-induced hypertriglyceridemia, estrogen-induced hypertriglyceridemia, glucocorticoid-induced hypertriglyceridemia, retinoid-induced hypertriglyceridemia, cimetidine-induced hypertriglyceridemia, and familial hypertriglyceridemia), acute pancreatitis associated with hypertriglyceridemia, chylomicron syndrom, familial chylomicronemia, Apo-E deficiency or resistance, LPL deficiency or hypoactivity, hyperlipidemia (including familial combined hyperlipidemia), hypercholesterolemia, gout associated with hypercholesterolemia, xanthomatosis (subcutaneous cholesterol deposits), hyperlipidemia with heterogeneous LPL deficiency, and hyperlipidemia with high LDL and heterogeneous LPL deficiency.

Cardiovascular diseases associated with disorders of lipid metabolism are also considered "disorders of lipid metabolism", as defined herein. These diseases may include coronary artery disease (also called ischemic heart disease), inflammation associated with coronary artery disease, restenosis, peripheral vascular diseases, and stroke.

Disorders related to body weight are also considered "disorders of lipid metabolism", as defined herein. Such disorders may include obesity, metabolic syndrome including independent components of metabolic syndrome (e.g., central obesity, FBG/pre-diabetes/diabetes, hypercholesterolemia, hypertriglyceridemia, and hypertension), hypothyroidism, uremia, and other conditions associated with weight gain (including rapid weight gain), weight loss, maintenance of weight loss, or risk of weight regain following weight loss.

Blood sugar disorders are further considered "disorders of lipid metabolism", as defined herein. Such disorders may include diabetes, hypertension, and polycystic ovarian syndrome related to insulin resistance. Other exemplary disorders of lipid metabolism may also include renal transplantation, nephrotic syndrome, Cushing's syndrome, acromegaly, systemic lupus erythematosus, dysglobulinemia, lipodystrophy, glycogenosis type I, and Addison's disease.

"Therapeutically effective amount," as used herein, is intended to include the amount of an RNAi agent that, when administered to a subject having an ANGPTL3-associated disease, is sufficient to effect treatment of the disease (e.g., by diminishing, ameliorating, or maintaining the existing disease or one or more symptoms of disease). The "therapeutically effective amount" may vary depending on the RNAi agent, how the agent is administered, the disease and its severity and the history, age, weight, family history, genetic makeup, the types of preceding or concomitant treatments, if any, and other individual characteristics of the subject to be treated.

"Prophylactically effective amount," as used herein, is intended to include the amount of an RNAi agent that, when administered to a subject having an ANGPTL3-associated disorder, is sufficient to prevent or ameliorate the disease or one or more symptoms of the disease. Ameliorating the disease includes slowing the course of the disease or reducing the severity of later-developing disease. The "prophylactically effective amount" may vary depending on the RNAi agent, how the agent is administered, the degree of risk of disease, and the history, age, weight, family history, genetic makeup, the types of preceding or concomitant treatments, if any, and other individual characteristics of the patient to be treated.

A "therapeutically-effective amount" or "prophylactically effective amount" also includes an amount of an RNAi agent that produces some desired effect at a reasonable benefit/risk ratio applicable to any treatment. The iRNA employed in the methods of the present invention may be administered in a sufficient amount to produce a reasonable benefit/risk ratio applicable to such treatment.

The phrase "pharmaceutically acceptable" is employed herein to refer to those compounds (including salts), materials, compositions, or dosage forms which are, within the scope of sound medical judgment, suitable for use in contact with the tissues of human subjects and animal subjects without excessive toxicity, irritation, allergic response, or other problem or complication, commensurate with a reasonable benefit/risk ratio.

The phrase "pharmaceutically-acceptable carrier" as used herein means a pharmaceutically-acceptable material, composition, or vehicle, such as a liquid or solid filler, diluent, excipient, manufacturing aid (e.g., lubricant, talc magnesium, calcium or zinc stearate, or steric acid), or solvent encapsulating material, involved in carrying or transporting the subject compound from one organ, or portion of the body, to another organ, or portion of the body. Each carrier must be "acceptable" in the sense of being compatible with the other ingredients of the formulation and not injurious to the subject being treated. Such carriers are known in the art. Pharmaceutically acceptable carriers include carriers for administration by injection.

The term "sample," as used herein, includes a collection of similar fluids, cells, or tissues isolated from a subject, as well as fluids, cells, or tissues present within a subject. Examples of biological fluids include blood, serum and serosal fluids, plasma, cerebrospinal fluid, ocular fluids, lymph, urine, saliva, and the like. Tissue samples may include samples from tissues, organs, or localized regions. For example, samples may be derived from particular organs, parts of organs, or fluids or cells within those organs. In certain embodiments, samples may be derived from the liver (e.g., whole liver or certain segments of liver or certain types of cells in the liver, such as, e.g., hepatocytes). In some embodiments, a "sample derived from a subject" refers to urine obtained from the subject. A "sample derived from a subject" can refer to blood or blood derived serum or plasma from the subject.

II. iRNAs of the Invention

The present invention provides iRNAs which inhibit the expression of an ANGPTL3 gene. In certain embodiments, the iRNA includes double stranded ribonucleic acid (dsRNA) molecules for inhibiting the expression of an ANGPTL3 gene in a cell, such as a cell within a subject, e.g., a mammal, such as a human susceptible to developing an ANGPTL3-associated disorder, e.g., a disorder of lipid metabolism, e.g., hyperlipidemia or hypertriglyceridemia. The dsRNAi agent includes an antisense strand having a region of complementarity which is complementary to at least a part of an mRNA formed in the expression of an ANGPTL3 gene. The region of complementarity is about 19-30 nucleotides in length (e.g., about 30, 29, 28, 27, 26, 25, 24, 23, 22, 21, 20, or 19 nucleotides in length).

Upon contact with a cell expressing the ANGPTL3 gene, the iRNA inhibits the expression of the ANGPTL3 gene (e.g., a human, a primate, a non-primate, or a rat ANGPTL3 gene) by at least about 50% as assayed by, for example, a PCR or branched DNA (bDNA)-based method, or by a protein-based method, such as by immunofluorescence analysis, using, for example, western blotting or flow cytometric techniques. In certain embodiments, inhibition of expression is determined by the qPCR method provided in the examples herein with the siRNA at, e.g., a 10 nM concentration, in an appropriate organism cell line provided therein. In certain embodiments, inhibition of expression in vivo is determined by knockdown of the human gene in a rodent expressing the human gene, e.g., a mouse or an AAV-infected mouse expressing the human target gene, e.g., when administered as single dose, e.g., at 3 mg/kg at the nadir of RNA expression.

A dsRNA includes two RNA strands that are complementary and hybridize to form a duplex structure under conditions in which the dsRNA will be used. One strand of a dsRNA (the antisense strand) includes a region of complementarity that is substantially complementary, and generally fully complementary, to a target sequence. The target sequence can be derived from the sequence of an mRNA formed during the expression of an ANGPTL3 gene. The other strand (the sense strand) includes a region that is complementary to the antisense strand, such that the two strands hybridize and form a duplex structure when combined under suitable conditions. As described elsewhere herein and as known in the art, the complementary sequences of a dsRNA can also be contained as self-complementary regions of a single nucleic acid molecule, as opposed to being on separate oligonucleotides.

Generally, the duplex structure is 15 to 30 base pairs in length, e.g., 15-29, 15-28, 15-27, 15-26, 15-25, 15-24, 15-23, 15-22, 15-21, 15-20, 15-19, 15-18, 15-17, 18-30, 18-29, 18-28, 18-27, 18-26, 18-25, 18-24, 18-23, 18-22, 18-21, 18-20, 19-30, 19-29, 19-28, 19-27, 19-26, 19-25, 19-24, 19-23, 19-22, 19-21, 19-20, 20-30, 20-29, 20-28, 20-27, 20-26, 20-25, 20-24, 20-23, 20-22, 20-21, 21-30, 21-29, 21-28, 21-27, 21-26, 21-25, 21-24, 21-23, or 21-22 base pairs in length. In certain embodiments, the duplex structure is 18 to 25 base pairs in length, e.g., 18-25, 18-24, 18-23, 18-22, 18-21, 18-20, 19-25, 19-24, 19-23, 19-22, 19-21, 19-20, 20-25, 20-24, 20-23, 20-22, 20-21, 21-25, 21-24, 21-23, 21-22, 22-25, 22-24, 22-23, 23-25, 23-24 or 24-25 base pairs in length, for example, 19-21 basepairs in length. Ranges and lengths intermediate to the above recited ranges and lengths are also contemplated to be part of the disclosure.

Similarly, the region of complementarity to the target sequence is 15 to 30 nucleotides in length, e.g., 15-29, 15-28, 15-27, 15-26, 15-25, 15-24, 15-23, 15-22, 15-21, 15-20, 15-19, 15-18, 15-17, 18-30, 18-29, 18-28, 18-27, 18-26, 18-25, 18-24, 18-23, 18-22, 18-21, 18-20, 19-30, 19-29, 19-28, 19-27, 19-26, 19-25, 19-24, 19-23, 19-22, 19-21, 19-20, 20-30, 20-29, 20-28, 20-27, 20-26, 20-25, 20-24,20-23, 20-22, 20-21, 21-30, 21-29, 21-28, 21-27, 21-26, 21-25, 21-24, 21-23, or 21-22 nucleotides in length, for example 19-23 nucleotides in length or 21-23 nucleotides in length. Ranges and lengths intermediate to the above recited ranges and lengths are also contemplated to be part of the disclosure.

In some embodiments, the duplex structure is 19 to 30 base pairs in length. Similarly, the region of complementarity to the target sequence is 19 to 30 nucleotides in length.

In some embodiments, the dsRNA is about 19 to about 23 nucleotides in length, or about 25 to about 30 nucleotides in length. In general, the dsRNA is long enough to serve as a substrate for the Dicer enzyme. For example, it is well-known in the art that dsRNAs longer than about 21-23 nucleotides in length may serve as substrates for Dicer. As the ordinarily skilled person will also recognize, the region of an RNA targeted for cleavage will most often be part of a larger RNA molecule, often an mRNA molecule. Where relevant, a "part" of an mRNA target is a contiguous sequence of an mRNA target of sufficient length to allow it to be a substrate for RNAi-directed cleavage (i.e., cleavage through a RISC pathway).

One of skill in the art will also recognize that the duplex region is a primary functional portion of a dsRNA, e.g., a duplex region of about 19 to about 30 base pairs, e.g., about 19-30, 19-29, 19-28, 19-27, 19-26, 19-25, 19-24, 19-23, 19-22, 19-21, 19-20, 20-30, 20-29, 20-28, 20-27, 20-26, 20-25, 20-24, 20-23, 20-22, 20-21, 21-30, 21-29, 21-28, 21-27, 21-26, 21-25, 21-24, 21-23, or 21-22 base pairs. Thus, in one embodiment, to the extent that it becomes processed to a functional duplex, of e.g., 15-30 base pairs, that targets a desired RNA for cleavage, an RNA molecule or complex of RNA molecules having a duplex region greater than 30 base pairs is a dsRNA. Thus, an ordinarily skilled artisan will recognize that in one embodiment, a miRNA is a dsRNA. In another embodiment, a dsRNA is not a naturally occurring miRNA. In another embodiment, an iRNA agent useful to target ANGPTL3 gene expression is not generated in the target cell by cleavage of a larger dsRNA.

A dsRNA as described herein can further include one or more single-stranded nucleotide overhangs, e.g., 1-4, 2-4, 1-3, 2-3, 1, 2, 3, or 4 nucleotides. dsRNAs having at least one nucleotide overhang can have superior inhibitory properties relative to their blunt-ended counterparts. A nucleotide overhang can comprise or consist of a nucleotide/nucleoside analog, including a deoxynucleotide/nucleoside. The overhang(s) can be on the sense strand, the antisense strand, or any combination thereof. Furthermore, the nucleotide(s) of an overhang can be present on the 5'-end, 3'-end, or both ends of an antisense or sense strand of a dsRNA.

A dsRNA can be synthesized by standard methods known in the art. Double stranded RNAi compounds of the invention may be prepared using a two-step procedure. First, the individual strands of the double stranded RNA molecule are prepared separately. Then, the component strands are annealed. The individual strands of the siRNA compound can be prepared using solution-phase or solid-phase organic synthesis or both. Organic synthesis offers the advantage that the oligonucleotide strands comprising unnatural or modified nucleotides can be easily prepared. Similarly, single-stranded oligonucleotides of the invention can be prepared using solution-phase or solid-phase organic synthesis or both.

In an aspect, a dsRNA of the invention includes at least two nucleotide sequences, a sense sequence and an antisense sequence. The sense strand is selected from the group of sequences provided in any one of Tables 2-3 and 7-8, and the corresponding antisense strand of the sense strand is selected from the group of sequences of any one of Tables 2-3 and 7-8. In this aspect, one of the two sequences is complementary to the other of the two sequences, with one of the sequences being substantially complementary to a sequence of an mRNA generated in the expression of an ANGPTL3 gene. As such, in this aspect, a dsRNA will include two oligonucleotides, where one oligonucleotide is described as the sense strand in any one of Tables 2-3 and 7-8, and the second oligonucleotide is described as the corresponding antisense strand of the sense strand in any one of Tables 2-3 and 7-8.

In certain embodiments, the substantially complementary sequences of the dsRNA are contained on separate oligonucleotides. In other embodiments, the substantially complementary sequences of the dsRNA are contained on a single oligonucleotide.

In one embodiment, the antisense strand comprises at least 15, e.g., 15, 16, 17, 18, 19, or 20, contiguous nucleotides differing by no more than 0, 1, 2, or 3 nucleotides from any one of the antisense strand nucleotide sequences of a duplex selected from the group consisting of AD-1331203.1; AD-1331206.1; AD-1331209.1; AD-1331212.1; AD-1331213.1; AD-1331329.1; AD-1331237.1; AD-1331238.1; AD-1331240.1; AD-1331244.1; AD-1331256.1; AD-1331262.1; AD-1331264.1; AD-1331265.1; AD-1331266.1; AD-1331316.1; and AD-1331338.1.

In one embodiment, the antisense strand comprises at least 15, e.g., 15, 16, 17, 18, 19, or 20, contiguous nucleotides differing by no more than 0, 1, 2, or 3 nucleotides from any one of the antisense strand nucleotide sequences of a duplex selected from the group consisting of AD-1331203.1; AD-1331206.1; AD-1331209.1; AD-1331212.1; AD-1331213.1; AD-1331329.1; AD-1331240.1; AD-1331262.1; AD-1331264.1; AD-1331265.1 and AD-1331266.1.

In one embodiment, the antisense strand comprises at least 15, e.g., 15, 16, 17, 18, 19, or 20, contiguous nucleotides differing by no more than 0, 1, 2, or 3 nucleotides from any one of the antisense strand nucleotide sequences of a duplex selected from the group consisting of AD-1331203.1; AD-1331206.1; AD-1331209.1; AD-1331212.1; and AD-1331213.1.

It will be understood that, although the sequences in, for example, Table 3, are not described as modified or conjugated sequences, the RNA of the iRNA of the invention e.g., a dsRNA of the invention, may comprise any one of the sequences set forth in any one of Tables 2-3 and 7-8 that is un-modified, un-conjugated, or modified or conjugated differently than described therein. In other words, the invention encompasses dsRNA of Tables 2-3 and 7-8 which are un-modified, un-conjugated, modified, or conjugated, as described herein.

The skilled person is well aware that dsRNAs having a duplex structure of about 20 to 23 base pairs, e.g., 21, base pairs have been hailed as particularly effective in inducing RNA interference (Elbashir et al., EMBO 2001, 20:6877-6888). However, others have found that shorter or longer RNA duplex structures can also be effective (Chu and Rana (2007) RNA 14:1714-1719; Kim et al. (2005) Nat Biotech 23:222-226). In the embodiments described above, by virtue of the nature of the oligonucleotide sequences provided in any one of Tables 2-3 and 7-8. dsRNAs described herein can include at least one strand of a length of minimally 21 nucleotides. It can be reasonably expected that shorter duplexes having any one of the sequences in any one of Tables 2-3 and 7-8 minus only a few nucleotides on one or both ends can be similarly effective as compared to the dsRNAs described above. Hence, dsRNAs having a sequence of at least 19, 20, or more contiguous nucleotides derived from any one of the sequences of any one of Tables 2-3 and 7-8, and differing in their ability to inhibit the expression of an ANGPTL3 gene by not more than about 5, 10, 15, 20, 25, or 30% inhibition from a dsRNA comprising the full sequence, are contemplated to be within the scope of the present invention.

In addition, the RNAs provided in Tables 2-3 and 7-8 identify a site(s) in an ANGPTL3 transcript that is susceptible to RISC-mediated cleavage. As such, the present invention further features iRNAs that target within one of these sites. As used herein, an iRNA is said to target within a particular site of an RNA transcript if the iRNA promotes cleavage of the transcript anywhere within that particular site. Such an iRNA will generally include at least about 19 contiguous nucleotides from any one of the sequences provided in any one of Tables 2-3 and 7-8 coupled to additional nucleotide sequences taken from the region contiguous to the selected sequence in an ANGPTL3 gene.

III. Modified iRNAs of the Invention

In certain embodiments, the RNA of the iRNA of the invention e.g., a dsRNA, is un-modified, and does not comprise, e.g., chemical modifications or conjugations known in the art and described herein. In other embodiments, the RNA of an iRNA of the invention, e.g., a dsRNA, is chemically modified to enhance stability or other beneficial characteristics. In certain embodiments of the invention, substantially all of the nucleotides of an iRNA of the invention are modified. In other embodiments of the invention, all of the nucleotides of an iRNA or substantially all of the nucleotides of an iRNA are modified, i.e., not more than 5, 4, 3, 2, or 1 unmodified nucleotides are present in a strand of the iRNA.

The nucleic acids featured in the invention can be synthesized or modified by methods well established in the art, such as those described in "Current protocols in nucleic acid chemistry," Beaucage, S. L. et al. (Edrs.), John Wiley & Sons, Inc., New York, NY, USA, which is hereby incorporated herein by reference. Modifications include, for example, end modifications, e.g., 5'-end modifications (phosphorylation, conjugation, inverted linkages) or 3'-end modifications (conjugation, DNA nucleotides, inverted linkages, etc.); base modifications, e.g., replacement with stabilizing bases, destabilizing bases, or bases that base pair with an expanded repertoire of partners, removal of bases (abasic nucleotides), or conjugated bases; sugar modifications (e.g., at the 2'-position or 4'-position) or replacement of the sugar; or backbone modifications, including modification or replacement of the phosphodiester linkages. Specific examples of iRNA compounds useful in the embodiments described herein include, but are not limited to RNAs containing modified backbones or no natural internucleoside linkages. RNAs having modified backbones include, among others, those that do not have a phosphorus atom in the backbone. For the purposes of this specification, and as sometimes referenced in the art, modified RNAs that do not have a phosphorus atom in their internucleoside backbone can also be considered to be oligonucleosides. In some embodiments, a modified iRNA will have a phosphorus atom in its internucleoside backbone.

Modified RNA backbones include, for example, phosphorothioates, chiral phosphorothioates, phosphorodithioates, phosphotriesters, aminoalkylphosphotriesters, methyl and other alkyl phosphonates including 3'-alkylene phosphonates and chiral phosphonates, phosphinates, phosphoramidates including 3'-amino phosphoramidate and aminoalkylphosphoramidates, thionophosphoramidates, thionoalkylphosphonates, thionoalkylphosphotriesters, and boranophosphates having normal 3'-5' linkages, 2'-5'-linked analogs of these, and those having inverted polarity wherein the adjacent pairs of nucleoside units are linked 3'-5' to 5'-3' or 2'-5' to 5'-2'. Various salts, mixed salts and free acid forms are also included. In some embodiments of the invention, the dsRNA agents of the invention are in a free acid form. In other embodiments of the invention, the dsRNA agents of the invention are in a salt form. In one embodiment, the dsRNA agents of the invention are in a sodium salt form. In certain embodiments, when the dsRNA agents of the invention are in the sodium salt form, sodium ions are present in the agent as counterions for substantially all of the phosphodiester and/or phosphorothiotate groups present in the agent. Agents in which substantially all of the phosphodiester and/or phosphorothioate linkages have a sodium counterion include not more than 5, 4, 3, 2, or 1 phosphodiester and/or phosphorothioate linkages without a sodium counterion. In some embodiments, when the dsRNA agents of the invention are in the sodium salt form, sodium ions are present in the agent as counterions for all of the phosphodiester and/or phosphorothiotate groups present in the agent.

Representative U.S. patents that teach the preparation of the above phosphorus-containing linkages include, but are not limited to, U.S. Pat. Nos. 3,687,808; 4,469,863; 4,476, 301; 5,023,243; 5,177,195; 5,188,897; 5,264,423; 5,276, 019; 5,278,302; 5,286,717; 5,321,131; 5,399,676; 5,405, 939; 5,453,496; 5,455,233; 5,466,677; 5,476,925; 5,519, 126; 5,536,821; 5,541,316; 5,550,111; 5,563,253; 5,571, 799; 5,587,361; 5,625,050; 6,028,188; 6,124,445; 6,160, 109; 6,169,170; 6,172,209; 6,239,265; 6,277,603; 6,326, 199; 6,346,614; 6,444,423; 6,531,590; 6,534,639; 6,608, 035; 6,683,167; 6,858,715; 6,867,294; 6,878,805; 7,015, 315; 7,041,816; 7,273,933; 7,321,029; and U.S. Pat. RE39464, the entire contents of each of which are hereby incorporated herein by reference.

Modified RNA backbones that do not include a phosphorus atom therein have backbones that are formed by short chain alkyl or cycloalkyl internucleoside linkages, mixed heteroatoms and alkyl or cycloalkyl internucleoside linkages, or one or more short chain heteroatomic or heterocyclic internucleoside linkages. These include those having morpholino linkages (formed in part from the sugar portion of a nucleoside); siloxane backbones; sulfide, sulfoxide and sulfone backbones; formacetyl and thioformacetyl backbones; methylene formacetyl and thioformacetyl backbones; alkene containing backbones; sulfamate backbones; methyleneimino and methylenehydrazino backbones; sulfonate and sulfonamide backbones; amide backbones; and others having mixed N, O, S, and $CH_2$ component parts.

Representative U.S. patents that teach the preparation of the above oligonucleosides include, but are not limited to, U.S. Pat. Nos. 5,034,506; 5,166,315; 5,185,444; 5,214,134; 5,216,141; 5,235,033; 5,64,562; 5,264,564; 5,405,938; 5,434,257; 5,466,677; 5,470,967; 5,489,677; 5,541,307; 5,561,225; 5,596,086; 5,602,240; 5,608,046; 5,610,289; 5,618,704; 5,623,070; 5,663,312; 5,633,360; 5,677,437; and 5,677,439, the entire contents of each of which are hereby incorporated herein by reference.

Suitable RNA mimetics are contemplated for use in iRNAs provided herein, in which both the sugar and the internucleoside linkage, i.e., the backbone, of the nucleotide units are replaced with novel groups. The base units are maintained for hybridization with an appropriate nucleic acid target compound. One such oligomeric compound in which an RNA mimetic that has been shown to have excellent hybridization properties is referred to as a peptide nucleic acid (PNA). In PNA compounds, the sugar backbone of an RNA is replaced with an amide containing backbone, in particular an aminoethylglycine backbone. The nucleobases are retained and are bound directly or indirectly to aza nitrogen atoms of the amide portion of the backbone. Representative US patents that teach the preparation of PNA compounds include, but are not limited to, U.S. Pat. Nos. 5,539,082; 5,714,331; and 5,719,262, the entire contents of each of which are hereby incorporated herein by reference. Additional PNA compounds suitable for use in the iRNAs of the invention are described in, for example, in Nielsen et al., *Science*, 1991, 254, 1497-1500.

Some embodiments featured in the invention include RNAs with phosphorothioate backbones and oligonucleosides with heteroatom backbones, and in particular —$CH_2$—NH—$CH_2$—, —$CH_2$—N($CH_3$)—O—$CH_2$— [known as a methylene (methylimino) or MMI backbone], —$CH_2$—O—N($CH_3$)—$CH_2$—, —$CH_2$—N($CH_3$)—N($CH_3$)—$CH_2$— and —N($CH_3$)—$CH_2$—$CH_2$— of the above-referenced U.S. Pat. No. 5,489,677, and the amide backbones of the above-referenced U.S. Pat. No. 5,602,240. In some embodiments, the RNAs featured herein have morpholino backbone structures of the above-referenced U.S. Pat. No. 5,034,506. The native phosphodiester backbone can be represented as O—P(O)(OH)—$OCH_2$—.

Modified RNAs can also contain one or more substituted sugar moieties. The iRNAs, e.g., dsRNAs, featured herein can include one of the following at the 2'-position: OH; F; O-, S-, or N-alkyl; O-, S-, or N-alkenyl; O-, S- or N-alkynyl; or O-alkyl-O-alkyl, wherein the alkyl, alkenyl and alkynyl can be substituted or unsubstituted $C_1$ to $C_{10}$ alkyl or $C_2$ to $C_{10}$ alkenyl and alkynyl. Exemplary suitable modifications include O[$(CH_2)_nO]_mCH_3$, O$(CH_2)_nOCH_3$, O$(CH_2)_nNH_2$, O$(CH_2)_nCH_3$, O$(CH_2)_nONH_2$, and O$(CH_2)_n$ON[$(CH_2)_nCH_3]_2$, where n and m are from 1 to about 10. In other embodiments, dsRNAs include one of the following at the 2' position: $C_1$ to $C_{10}$ lower alkyl, substituted lower alkyl, alkaryl, aralkyl, O-alkaryl or O-aralkyl, SH, $SCH_3$, OCN, Cl, Br, CN, $CF_3$, $OCF_3$, $SOCH_3$, $SO_2CH_3$, $ONO_2$, $N_3$, $NH_2$, heterocycloalkyl, heterocycloalkaryl, aminoalkylamino, polyalkylamino, substituted silyl, an RNA cleaving group, a reporter group, an intercalator, a group for improving the pharmacokinetic properties of an iRNA, or a group for improving the pharmacodynamic properties of an iRNA, and other substituents having similar properties. In some embodiments, the modification includes a 2'-methoxyethoxy (2' $CH_2CH_2OCH_3$, also known as 2'-O-(2-methoxyethyl) or 2'-MOE) (Martin et al., *Helv. Chim. Acta*, 1995, 78:486-504) i.e., an alkoxy-alkoxy group. Another exemplary modification is 2'-dimethylaminooxyethoxy, i.e., a O$(CH_2)_2$ON($CH_3)_2$ group, also known as 2'-DMAOE, as described in examples herein below, and 2'-dimethylaminoethoxyethoxy (also known in the art as 2' dimethylaminoethoxyethyl or 2'-DMAEOE), i.e., 2'-O—$CH_2$—O—$CH_2$—N($CH_3)_2$. Further exemplary modifications include: 5'-Me-2'-F nucleotides, 5'-Me-2'-OMe nucleotides, 5'-Me-2'-deoxynucleotides, (both R and S isomers in these three families); 2'-alkoxyalkyl; and 2'-NMA (N-methylacetamide).

Other modifications include 2'-methoxy (2'-$OCH_3$), 2'-aminopropoxy (2'-$OCH_2CH_2CH_2NH_2$) and 2'-fluoro (2'-F). Similar modifications can also be made at other positions on the RNA of an iRNA, particularly the 3' position of the sugar on the 3' terminal nucleotide or in 2'-5' linked dsRNAs and the 5' position of 5' terminal nucleotide. iRNAs can also have sugar mimetics such as cyclobutyl moieties in place of the pentofuranosyl sugar. Representative US patents that teach the preparation of such modified sugar structures include, but are not limited to, U.S. Pat. Nos. 4,981,957; 5,118,800; 5,319,080; 5,359,044; 5,393,878; 5,446,137; 5,466,786; 5,514,785; 5,519,134; 5,567,811; 5,576,427; 5,591,722; 5,597,909; 5,610,300; 5,627,053; 5,639,873; 5,646,265; 5,658,873; 5,670,633; and 5,700,920, certain of which are commonly owned with the instant application. The entire contents of each of the foregoing are hereby incorporated herein by reference.

An iRNA can also include nucleobase (often referred to in the art simply as "base") modifications or substitutions. As used herein, "unmodified" or "natural" nucleobases include the purine bases adenine (A) and guanine (G), and the pyrimidine bases thymine (T), cytosine (C), and uracil (U). Modified nucleobases include other synthetic and natural nucleobases such as deoxythimidine (dT), 5-methylcytosine (5-me-C), 5-hydroxymethyl cytosine, xanthine, hypoxanthine, 2-aminoadenine, 6-methyl and other alkyl derivatives of adenine and guanine, 2-propyl and other alkyl derivatives of adenine and guanine, 2-thiouracil, 2-thiothymine and 2-thiocytosine, 5-halouracil and cytosine, 5-propynyl uracil and cytosine, 6-azo uracil, cytosine and thymine, 5-uracil (pseudouracil), 4-thiouracil, 8-halo, 8-amino, 8-thiol, 8-thioalkyl, 8-hydroxyl anal other 8-substituted adenines and guanines, 5-halo, particularly 5-bromo, 5-trifluoromethyl and other 5-substituted uracils and cytosines, 7-methylguanine and 7-methyladenine, 8-azaguanine and 8-azaadenine, 7-deazaguanine and 7-daazaadenine and 3-deazaguanine and 3-deazaadenine. Further nucleobases include those disclosed in U.S. Pat. No. 3,687,808, those disclosed in Modified Nucleosides in Biochemistry, Biotechnology and Medicine, Herdewijn, P. ed. Wiley-VCH, 2008; those disclosed in The Concise Encyclopedia Of Polymer *Science* And Engineering, pages 858-859, Kroschwitz, J. L, ed. John Wiley & Sons, 1990, these disclosed by Englisch et al., Angewandte Chemie, International Edition, 1991, 30, 613, and those disclosed by Sanghvi, Y S., Chapter 15, dsRNA Research and Applications, pages 289-302, Crooke, S. T. and Lebleu, B., Ed., CRC Press, 1993. Certain of these nucleobases are particularly useful for increasing the binding affinity of the oligomeric compounds featured in the invention. These include 5-substituted pyrimidines, 6-azapyrimidines and N-2, N-6 and 0-6 substituted purines, including 2-aminopropyladenine, 5-propynyluracil and 5-propynylcytosine. 5-methylcytosine substitutions have been shown to increase nucleic acid duplex stability by 0.6-1.2° C. (Sanghvi, Y. S., Crooke, S. T. and Lebleu, B., Eds., dsRNA Research and Applications, CRC Press, Boca Raton, 1993, pp. 276-278) and are exemplary base substitutions, even more particularly when combined with 2'-O-methoxyethyl sugar modifications.

Representative U.S. patents that teach the preparation of certain of the above noted modified nucleobases as well as other modified nucleobases include, but are not limited to, the above noted U.S. Pat. Nos. 3,687,808, 4,845,205; 5,130,30; 5,134,066; 5,175,273; 5,367,066; 5,432,272; 5,457,187; 5,459,255; 5,484,908; 5,502,177; 5,525,711; 5,552,540; 5,587,469; 5,594,121; 5,596,091; 5,614,617; 5,681,941; 5,750,692; 6,015,886; 6,147,200; 6,166,197; 6,222,025; 6,235,887; 6,380,368; 6,528,640; 6,639,062; 6,617,438; 7,045,610; 7,427,672; and 7,495,088, the entire contents of each of which are hereby incorporated herein by reference.

In some embodiments, an RNAi agent of the disclosure can also be modified to include one or more bicyclic sugar moieties. A "bicyclic sugar" is a furanosyl ring modified by a ring formed by the bridging of two carbons, whether adjacent or non-adjacent. A "bicyclic nucleoside" ("BNA") is a nucleoside having a sugar moiety comprising a ring formed by bridging two carbons, whether adjacent or non-adjacent, of the sugar ring, thereby forming a bicyclic ring system. In certain embodiments, the bridge connects the 4'-carbon and the 2'-carbon of the sugar ring, optionally, via the 2'-acyclic oxygen atom. Thus, in some embodiments an agent of the invention may include one or more locked nucleic acids (LNA). A locked nucleic acid is a nucleotide having a modified ribose moiety in which the ribose moiety comprises an extra bridge connecting the 2' and 4' carbons. In other words, an LNA is a nucleotide comprising a bicyclic sugar moiety comprising a 4'-$CH_2$—O-2' bridge. This structure effectively "locks" the ribose in the 3'-endo structural conformation. The addition of locked nucleic acids to siRNAs has been shown to increase siRNA stability in serum, and to reduce off-target effects (Elmen, J. et al., (2005) *Nucleic Acids Research* 33(1):439-447; Mook, O R. et al., (2007) *Mol Canc Ther* 6(3):833-843; Grunweller, A. et al., (2003) *Nucleic Acids Research* 31(12):3185-3193). Examples of bicyclic nucleosides for use in the polynucleotides of the invention include without limitation nucleosides comprising a bridge between the 4' and the 2' ribosyl ring atoms. In certain embodiments, the antisense polynucleotide agents of the invention include one or more bicyclic nucleosides comprising a 4' to 2' bridge.

A locked nucleoside can be represented by the structure (omitting stereochemistry),

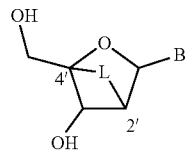

wherein B is a nucleobase or modified nucleobase and L is the linking group that joins the 2'-carbon to the 4'-carbon of the ribose ring. Examples of such 4' to 2' bridged bicyclic nucleosides, include but are not limited to 4'-($CH_2$)—O-2' (LNA); 4'-($CH_2$)—S-2'; 4'-($CH_2$)$_2$—O-2' (ENA); 4'-$CH(CH_3)$—O-2' (also referred to as "constrained ethyl" or "cEt") and 4'-CH($CH_2OCH_3$)—O-2' (and analogs thereof; see, e.g., U.S. Pat. No. 7,399,845); 4'-$C(CH_3)(CH_3)$—O-2' (and analogs thereof; see e.g., U.S. Pat. No. 8,278,283); 4'-$CH_2$—N($OCH_3$)-2' (and analogs thereof; see e.g., U.S. Pat. No. 8,278,425); 4'-$CH_2$—O—N($CH_3$)-2' (see, e.g., U.S. Patent Publication No. 2004/0171570); 4'-$CH_2$—N(R)—O-2', wherein R is H, $C_1$-$C_{12}$ alkyl, or a nitrogen protecting group (see, e.g., U.S. Pat. No. 7,427,672); 4'-$CH_2$—C(H)($CH_3$)-2' (see, e.g., Chattopadhyaya et al., *J. Org. Chem.*, 2009, 74, 118-134); and 4'-$CH_2$—C($=CH_2$)-2' (and analogs thereof; see, e.g., U.S. Pat. No. 8,278,426). The entire contents of each of the foregoing are hereby incorporated herein by reference.

Additional representative U.S. patents and U.S. patent Publications that teach the preparation of locked nucleic acid nucleotides include, but are not limited to, the following: U.S. Pat. Nos. 6,268,490; 6,525,191; 6,670,461; 6,770,748; 6,794,499; 6,998,484; 7,053,207; 7,034,133; 7,084,125; 7,399,845; 7,427,672; 7,569,686; 7,741,457; 8,022,193; 8,030,467; 8,278,425; 8,278,426; 8,278,283; US 2008/0039618; and US 2009/0012281, the entire contents of each of which are hereby incorporated herein by reference.

Any of the foregoing bicyclic nucleosides can be prepared having one or more stereochemical sugar configurations including for example α-L-ribofuranose and β-D-ribofuranose (see WO 99/14226).

The RNA of an iRNA can also be modified to include one or more constrained ethyl nucleotides. As used herein, a "constrained ethyl nucleotide" or "cEt" is a locked nucleic acid comprising a bicyclic sugar moiety comprising a 4'-CH($CH_3$)—O-2' bridge (i.e., L in the preceding structure). In one embodiment, a constrained ethyl nucleotide is in the S conformation referred to herein as "S-cEt."

An iRNA of the invention may also include one or more "conformationally restricted nucleotides" ("CRN"). CRN are nucleotide analogs with a linker connecting the C2' and C4' carbons of ribose or the C3 and —C5' carbons of ribose. CRN lock the ribose ring into a stable conformation and increase the hybridization affinity to mRNA. The linker is of sufficient length to place the oxygen in an optimal position for stability and affinity resulting in less ribose ring puckering.

Representative publications that teach the preparation of certain of the above noted CRN include, but are not limited to, U.S. Patent Publication No. 2013/0190383; and PCT publication WO 2013/036868, the entire contents of each of which are hereby incorporated herein by reference.

In some embodiments, an iRNA of the invention comprises one or more monomers that are UNA (unlocked nucleic acid) nucleotides. UNA is unlocked acyclic nucleic acid, wherein any of the bonds of the sugar has been removed, forming an unlocked "sugar" residue. In one example, UNA also encompasses monomer with bonds between C1'-C4' have been removed (i.e. the covalent carbon-oxygen-carbon bond between the C1' and C4' carbons). In another example, the C2'-C3' bond (i.e. the covalent carbon-carbon bond between the C2' and C3' carbons) of the sugar has been removed (see *Nuc. Acids Symp. Series*, 52, 133-134 (2008) and Fluiter et al., *Mol. Biosyst.*, 2009, 10, 1039 hereby incorporated by reference).

Representative U.S. publications that teach the preparation of UNA include, but are not limited to, U.S. Pat. No. 8,314,227; and U.S. Patent Publication Nos. 2013/0096289; 2013/0011922; and 2011/0313020, the entire contents of each of which are hereby incorporated herein by reference.

Potentially stabilizing modifications to the ends of RNA molecules can include N-(acetylaminocaproyl)-4-hydroxyprolinol (Hyp-C6-NHAc), N-(caproyl-4-hydroxyprolinol (Hyp-C6), N-(acetyl-4-hydroxyprolinol (Hyp-NHAc), thymidine-2'-O-deoxythymidine (ether), N-(aminocaproyl)-4-hydroxyprolinol (Hyp-C6-amino), 2-docosanoyl-uridine-3'-phosphate, inverted 2'-deoxy-modified ribonucleotide, such as inverted dT(idT), inverted dA (idA), and inverted abasic 2'-deoxyribonucleotide (iAb) and others. Disclosure of this modification can be found in WO 2011/005861.

In one example, the 3' or 5' terminal end of a oligonucleotide is linked to an inverted 2'-deoxy-modified ribonucleotide, such as inverted dT(idT), inverted dA (idA), or a inverted abasic 2'-deoxyribonucleotide (iAb). In one particular example, the inverted 2'-deoxy-modified ribonucleotide is linked to the 3' end of an oligonucleotide, such as the 3'-end of a sense strand described herein, where the linking is via a 3'-3' phosphodiester linkage or a 3'-3'-phosphorothioate linkage.

In another example, the 3'-end of a sense strand is linked via a 3'-3'-phosphorothioate linkage to an inverted abasic ribonucleotide (iAb). In another example, the 3'-end of a sense strand is linked via a 3'-3'-phosphorothioate linkage to an inverted dA (idA).

In one particular example, the inverted 2'-deoxy-modified ribonucleotide is linked to the 3' end of an oligonucleotide, such as the 3'-end of a sense strand described herein, where the linking is via a 3'-3' phosphodiester linkage or a 3'-3'-phosphorothioate linkage.

In another example, the 3'-terminal nucleotides of a sense strand is an inverted dA (idA) and is linked to the preceding nucleotide via a 3'-3'-linkage (e.g., 3'-3'-phosphorothioate linkage).

Other modifications of the nucleotides of an iRNA of the invention include a 5' phosphate or 5' phosphate mimic, e.g., a 5'-terminal phosphate or phosphate mimic on the antisense strand of an iRNA. Suitable phosphate mimics are disclosed in, for example U.S. Patent Publication No. 2012/0157511, the entire contents of which are incorporated herein by reference.

A. Modified iRNAs Comprising Motifs of the Invention

In certain aspects of the invention, the double stranded RNA agents of the invention include agents with chemical modifications as disclosed, for example, in WO2013/075035, the entire contents of each of which are incorporated herein by reference. As shown herein and in WO2013/075035, one or more motifs of three identical modifications on three consecutive nucleotides may be introduced into a sense strand or antisense strand of a dsRNAi agent, particularly at or near the cleavage site. In some embodiments, the sense strand and antisense strand of the dsRNAi agent may otherwise be completely modified. The introduction of these motifs interrupts the modification pattern, if present, of the sense or antisense strand. The dsRNAi agent may be optionally conjugated with a GalNAc derivative ligand, for instance on the sense strand.

More specifically, when the sense strand and antisense strand of the double stranded RNA agent are completely modified to have one or more motifs of three identical modifications on three consecutive nucleotides at or near the cleavage site of at least one strand of a dsRNAi agent, the gene silencing activity of the dsRNAi agent was observed.

Accordingly, the invention provides double stranded RNA agents capable of inhibiting the expression of a target gene (i.e., ANGPTL3 gene) in vivo. The RNAi agent comprises a sense strand and an antisense strand. Each strand of the RNAi agent may be, for example, 17-30 nucleotides in length, 25-30 nucleotides in length, 27-30 nucleotides in length, 19-25 nucleotides in length, 19-23 nucleotides in length, 19-21 nucleotides in length, 21-25 nucleotides in length, or 21-23 nucleotides in length.

The sense strand and antisense strand typically form a duplex double stranded RNA ("dsRNA"), also referred to herein as "dsRNAi agent." The duplex region of a dsRNAi agent may be, for example, the duplex region can be 27-30 nucleotide pairs in length, 19-25 nucleotide pairs in length, 19-23 nucleotide pairs in length, 19-21 nucleotide pairs in length, 21-25 nucleotide pairs in length, or 21-23 nucleotide pairs in length. In another example, the duplex region is selected from 19, 20, 21, 22, 23, 24, 25, 26, and 27 nucleotides in length.

In certain embodiments, the dsRNAi agent may contain one or more overhang regions or capping groups at the 3'-end, 5'-end, or both ends of one or both strands. The overhang can be, independently, 1-6 nucleotides in length, for instance 2-6 nucleotides in length, 1-5 nucleotides in length, 2-5 nucleotides in length, 1-4 nucleotides in length, 2-4 nucleotides in length, 1-3 nucleotides in length, 2-3 nucleotides in length, or 1-2 nucleotides in length. In certain embodiments, the overhang regions can include extended overhang regions as provided above. The overhangs can be the result of one strand being longer than the other, or the result of two strands of the same length being staggered. The overhang can form a mismatch with the target mRNA or it can be complementary to the gene sequences being targeted or can be another sequence. The first and second strands can also be joined, e.g., by additional bases to form a hairpin, or by other non-base linkers.

In certain embodiments, the nucleotides in the overhang region of the dsRNAi agent can each independently be a modified or unmodified nucleotide including, but no limited to 2'-sugar modified, such as, 2'-F, 2'-O-methyl, thymidine (T), 2'-O-methoxyethyl-5-methyluridine (Teo), 2'-O-methoxyethyladenosine (Aeo), 2'-O-methoxyethyl-5-methylcytidine (m5Ceo), and any combinations thereof.

For example, TT can be an overhang sequence for either end on either strand. The overhang can form a mismatch with the target mRNA or it can be complementary to the gene sequences being targeted or can be another sequence.

The 5'- or 3'-overhangs at the sense strand, antisense strand, or both strands of the dsRNAi agent may be phosphorylated. In some embodiments, the overhang region(s) contains two nucleotides having a phosphorothioate between the two nucleotides, where the two nucleotides can be the same or different. In some embodiments, the overhang is present at the 3'-end of the sense strand, antisense strand, or both strands. In some embodiments, this 3'-overhang is present in the antisense strand. In some embodiments, this 3'-overhang is present in the sense strand.

The dsRNAi agent may contain only a single overhang, which can strengthen the interference activity of the RNAi, without affecting its overall stability. For example, the single-stranded overhang may be located at the 3'-end of the sense strand or, alternatively, at the 3'-end of the antisense strand. The RNAi may also have a blunt end, located at the 5'-end of the antisense strand (i.e., the 3'-end of the sense strand) or vice versa. Generally, the antisense strand of the dsRNAi agent has a nucleotide overhang at the 3'-end, and the 5'-end is blunt. While not wishing to be bound by theory, the asymmetric blunt end at the 5'-end of the antisense strand and 3'-end overhang of the antisense strand favor the guide strand loading into RISC process.

In certain embodiments, the dsRNAi agent is a double blunt-ended of 19 nucleotides in length, wherein the sense strand contains at least one motif of three 2'-F modifications on three consecutive nucleotides at positions 7, 8, 9 from the 5' end. The antisense strand contains at least one motif of three 2'-O-methyl modifications on three consecutive nucleotides at positions 11, 12, and 13 from the 5' end.

In other embodiments, the dsRNAi agent is a double blunt-ended of 20 nucleotides in length, wherein the sense strand contains at least one motif of three 2'-F modifications on three consecutive nucleotides at positions 8, 9, and 10 from the 5' end. The antisense strand contains at least one motif of three 2'-O-methyl modifications on three consecutive nucleotides at positions 11, 12, and 13 from the 5' end.

In yet other embodiments, the dsRNAi agent is a double blunt-ended of 21 nucleotides in length, wherein the sense strand contains at least one motif of three 2'-F modifications on three consecutive nucleotides at positions 9, 10, and 11 from the 5' end. The antisense strand contains at least one motif of three 2'-O-methyl modifications on three consecutive nucleotides at positions 11, 12, and 13 from the 5' end.

In certain embodiments, the dsRNAi agent comprises a 21 nucleotide sense strand and a 23 nucleotide antisense strand, wherein the sense strand contains at least one motif of three 2'-F modifications on three consecutive nucleotides at positions 9, 10, and 11 from the 5' end; the antisense strand contains at least one motif of three 2'-O-methyl modifications on three consecutive nucleotides at positions 11, 12, and 13 from the 5' end, wherein one end of the RNAi agent is blunt, while the other end comprises a 2 nucleotide overhang. In one embodiment, the 2 nucleotide overhang is at the 3'-end of the antisense strand.

When the 2 nucleotide overhang is at the 3'-end of the antisense strand, there may be two phosphorothioate internucleotide linkages between the terminal three nucleotides, wherein two of the three nucleotides are the overhang nucleotides, and the third nucleotide is a paired nucleotide next to the overhang nucleotide. In one embodiment, the RNAi agent additionally has two phosphorothioate internucleotide linkages between the terminal three nucleotides at both the 5'-end of the sense strand and at the 5'-end of the antisense strand. In certain embodiments, every nucleotide in the sense strand and the antisense strand of the dsRNAi agent, including the nucleotides that are part of the motifs are modified nucleotides. In certain embodiments each residue is independently modified with a 2'-O-methyl or 3'-fluoro, e.g., in an alternating motif. Optionally, the dsRNAi agent further comprises a ligand (such as, GalNAc$_3$).

In certain embodiments, the dsRNAi agent comprises a sense and an antisense strand, wherein the sense strand is 25-30 nucleotide residues in length, wherein starting from the 5' terminal nucleotide (position 1) positions 1 to 23 of the first strand comprise at least 8 ribonucleotides; the antisense strand is 36-66 nucleotide residues in length and, starting from the 3' terminal nucleotide, comprises at least 8 ribonucleotides in the positions paired with positions 1-23 of sense strand to form a duplex; wherein at least the 3 ' terminal nucleotide of antisense strand is unpaired with sense strand, and up to 6 consecutive 3' terminal nucleotides are unpaired with sense strand, thereby forming a 3' single stranded overhang of 1-6 nucleotides; wherein the 5' terminus of antisense strand comprises from 10-30 consecutive nucleotides which are unpaired with sense strand, thereby forming a 10-30 nucleotide single stranded 5' overhang; wherein at least the sense strand 5' terminal and 3' terminal nucleotides are base paired with nucleotides of antisense strand when sense and antisense strands are aligned for maximum complementarity, thereby forming a substantially duplexed region between sense and antisense strands; and antisense strand is sufficiently complementary to a target RNA along at least 19 ribonucleotides of antisense strand length to reduce target gene expression when the double stranded nucleic acid is introduced into a mammalian cell; and wherein the sense strand contains at least one motif of three 2'-F modifications on three consecutive nucleotides, where at least one of the motifs occurs at or near the cleavage site. The antisense strand contains at least one motif of three 2'-O-methyl modifications on three consecutive nucleotides at or near the cleavage site.

In certain embodiments, the dsRNAi agent comprises sense and antisense strands, wherein the dsRNAi agent comprises a first strand having a length which is at least 25 and at most 29 nucleotides and a second strand having a length which is at most 30 nucleotides with at least one motif of three 2'-O-methyl modifications on three consecutive nucleotides at position 11, 12, 13 from the 5' end; wherein the 3' end of the first strand and the 5' end of the second strand form a blunt end and the second strand is 1~4 nucleotides longer at its 3' end than the first strand, wherein the duplex region which is at least 25 nucleotides in length, and the second strand is sufficiently complementary to a target mRNA along at least 19 nucleotide of the second strand length to reduce target gene expression when the RNAi agent is introduced into a mammalian cell, and wherein Dicer cleavage of the dsRNAi agent results in an siRNA comprising the 3'-end of the second strand, thereby reducing expression of the target gene in the mammal. Optionally, the dsRNAi agent further comprises a ligand.

In certain embodiments, the sense strand of the dsRNAi agent contains at least one motif of three identical modifications on three consecutive nucleotides, where one of the motifs occurs at the cleavage site in the sense strand.

In certain embodiments, the antisense strand of the dsRNAi agent can also contain at least one motif of three identical modifications on three consecutive nucleotides, where one of the motifs occurs at or near the cleavage site in the antisense strand.

For a dsRNAi agent having a duplex region of 19-23 nucleotides in length, the cleavage site of the antisense strand is typically around the 10, 11, and 12 positions from the 5'-end. Thus the motifs of three identical modifications may occur at the 9, 10, 11 positions; the 10, 11, 12 positions; the 11, 12, 13 positions; the 12, 13, 14 positions; or the 13, 14, 15 positions of the antisense strand, the count starting from the first nucleotide from the 5'-end of the antisense strand, or, the count starting from the first paired nucleotide within the duplex region from the 5'-end of the antisense strand. The cleavage site in the antisense strand may also change according to the length of the duplex region of the dsRNAi agent from the 5'-end.

The sense strand of the dsRNAi agent may contain at least one motif of three identical modifications on three consecutive nucleotides at the cleavage site of the strand; and the antisense strand may have at least one motif of three identical modifications on three consecutive nucleotides at or near the cleavage site of the strand. When the sense strand and the antisense strand form a dsRNA duplex, the sense strand and the antisense strand can be so aligned that one motif of the three nucleotides on the sense strand and one motif of the three nucleotides on the antisense strand have at least one nucleotide overlap, i.e., at least one of the three nucleotides of the motif in the sense strand forms a base pair with at least one of the three nucleotides of the motif in the antisense strand. Alternatively, at least two nucleotides may overlap, or all three nucleotides may overlap.

In some embodiments, the sense strand of the dsRNAi agent may contain more than one motif of three identical modifications on three consecutive nucleotides. The first motif may occur at or near the cleavage site of the strand and the other motifs may be a wing modification. The term "wing modification" herein refers to a motif occurring at another portion of the strand that is separated from the motif at or near the cleavage site of the same strand. The wing modification is either adjacent to the first motif or is separated by at least one or more nucleotides. When the motifs are immediately adjacent to each other then the chemistries of the motifs are distinct from each other, and when the motifs are separated by one or more nucleotide than the chemistries can be the same or different. Two or more wing modifications may be present. For instance, when two wing modifications are present, each wing modification may occur at one end relative to the first motif which is at or near cleavage site or on either side of the lead motif.

Like the sense strand, the antisense strand of the dsRNAi agent may contain more than one motif of three identical modifications on three consecutive nucleotides, with at least one of the motifs occurring at or near the cleavage site of the strand. This antisense strand may also contain one or more wing modifications in an alignment similar to the wing modifications that may be present on the sense strand.

In some embodiments, the wing modification on the sense strand or antisense strand of the dsRNAi agent typically does not include the first one or two terminal nucleotides at the 3'-end, 5'-end, or both ends of the strand.

In other embodiments, the wing modification on the sense strand or antisense strand of the dsRNAi agent typically does not include the first one or two paired nucleotides within the duplex region at the 3'-end, 5'-end, or both ends of the strand.

When the sense strand and the antisense strand of the dsRNAi agent each contain at least one wing modification, the wing modifications may fall on the same end of the duplex region, and have an overlap of one, two, or three nucleotides.

When the sense strand and the antisense strand of the dsRNAi agent each contain at least two wing modifications, the sense strand and the antisense strand can be so aligned that two modifications each from one strand fall on one end of the duplex region, having an overlap of one, two, or three nucleotides; two modifications each from one strand fall on the other end of the duplex region, having an overlap of one, two or three nucleotides; two modifications one strand fall on each side of the lead motif, having an overlap of one, two or three nucleotides in the duplex region.

In some embodiments, every nucleotide in the sense strand and antisense strand of the dsRNAi agent, including the nucleotides that are part of the motifs, may be modified. Each nucleotide may be modified with the same or different modification which can include one or more alteration of one or both of the non-linking phosphate oxygens or of one or more of the linking phosphate oxygens; alteration of a constituent of the ribose sugar, e.g., of the 2'-hydroxyl on the ribose sugar; wholesale replacement of the phosphate moiety with "dephospho" linkers; modification or replacement of a naturally occurring base; and replacement or modification of the ribose-phosphate backbone.

As nucleic acids are polymers of subunits, many of the modifications occur at a position which is repeated within a nucleic acid, e.g., a modification of a base, or a phosphate moiety, or a non-linking 0 of a phosphate moiety. In some cases the modification will occur at all of the subject positions in the nucleic acid but in many cases it will not. By way of example, a modification may only occur at a 3'- or 5' terminal position, may only occur in a terminal region, e.g., at a position on a terminal nucleotide or in the last 2, 3, 4, 5, or 10 nucleotides of a strand. A modification may occur in a double strand region, a single strand region, or in both. A modification may occur only in the double strand region of an RNA or may only occur in a single strand region of a RNA. For example, a phosphorothioate modification at a non-linking 0 position may only occur at one or both termini, may only occur in a terminal region, e.g., at a position on a terminal nucleotide or in the last 2, 3, 4, 5, or 10 nucleotides of a strand, or may occur in double strand and single strand regions, particularly at termini. The 5'-end or ends can be phosphorylated.

It may be possible, e.g., to enhance stability, to include particular bases in overhangs, or to include modified nucleotides or nucleotide surrogates, in single strand overhangs, e.g., in a 5'- or 3'-overhang, or in both. For example, it can be desirable to include purine nucleotides in overhangs. In some embodiments all or some of the bases in a 3'- or 5'-overhang may be modified, e.g., with a modification described herein. Modifications can include, e.g., the use of modifications at the 2' position of the ribose sugar with modifications that are known in the art, e.g., the use of deoxyribonucleotides, 2'-deoxy-2'-fluoro (2'-F) or 2'-O-methyl modified instead of the ribosugar of the nucleobase, and modifications in the phosphate group, e.g., phosphorothioate modifications. Overhangs need not be homologous with the target sequence.

In some embodiments, each residue of the sense strand and antisense strand is independently modified with LNA, CRN, cET, UNA, HNA, CeNA, 2'-methoxyethyl, 2'-O-methyl, 2'-O-allyl, 2'-C-allyl, 2'-deoxy, 2'-hydroxyl, or 2'-fluoro. The strands can contain more than one modification. In one embodiment, each residue of the sense strand and antisense strand is independently modified with 2'-O-methyl or 2'-fluoro.

At least two different modifications are typically present on the sense strand and antisense strand. Those two modifications may be the 2'-O-methyl or 2'-fluoro modifications, or others.

In certain embodiments, the $N_a$ or $N_b$ comprise modifications of an alternating pattern. The term "alternating motif" as used herein refers to a motif having one or more modifications, each modification occurring on alternating nucleotides of one strand. The alternating nucleotide may refer to one per every other nucleotide or one per every three nucleotides, or a similar pattern. For example, if A, B and C each represent one type of modification to the nucleotide, the alternating motif can be "ABABABABABAB . . . ," "AAB-BAABBAABB . . . ," "AABAABAABAAB . . . ," "AAA-BAAABAAAB . . . ," "AAABBBAAABBB . . . ," or "ABCABCABCABC . . . ," etc.

The type of modifications contained in the alternating motif may be the same or different. For example, if A, B, C, D each represent one type of modification on the nucleotide, the alternating pattern, i.e., modifications on every other nucleotide, may be the same, but each of the sense strand or antisense strand can be selected from several possibilities of modifications within the alternating motif such as "ABA-BAB . . . ", "ACACAC . . . " "BDBDBD . . . " or "CDCDCD . . . ," etc.

In some embodiments, the dsRNAi agent of the invention comprises the modification pattern for the alternating motif on the sense strand relative to the modification pattern for the alternating motif on the antisense strand is shifted. The shift may be such that the modified group of nucleotides of the sense strand corresponds to a differently modified group of nucleotides of the antisense strand and vice versa. For example, the sense strand when paired with the antisense strand in the dsRNA duplex, the alternating motif in the sense strand may start with "ABABAB" from 5' to 3' of the strand and the alternating motif in the antisense strand may start with "BABABA" from 5' to 3' of the strand within the duplex region. As another example, the alternating motif in the sense strand may start with "AABBAABB" from 5' to 3' of the strand and the alternating motif in the antisense strand may start with "BBAABBAA" from 5' to 3' of the strand within the duplex region, so that there is a complete or partial shift of the modification patterns between the sense strand and the antisense strand.

In one particular example, the alternating motif in the sense strand is "ABABAB" sfrom 5' 3' of the strand, where each A is an unmodified ribonucleotide and each B is a 2'-Omethyl modified nucleotide.

In one particular example, the alternating motif in the sense strand is "ABABAB" sfrom 5' 3' of the strand, where each A is an 2'-deoxy-2'-fluoro modified nucleotide and each B is a 2'-Omethyl modified nucleotide.

In another particular example, the alternating motif in the antisense strand is "BABABA" from 3'-5' of the strand, where each A is a 2'-deoxy-2'-fluoro modified nucleotide and each B is a 2'-Omethyl modified nucleotide.

In one particular example, the alternating motif in the sense strand is "ABABAB" sfrom 5' 3' of the strand and the alternating motif in the antisense strand is "BABABA" from 3'-5' of the strand, where each A is an unmodified ribonucleotide and each B is a 2'-Omethyl modified nucleotide.

In one particular example, the alternating motif in the sense strand is "ABABAB" sfrom 5' 3' of the strand and the alternating motif in the antisense strand is "BABABA" from 3'-5' of the strand, where each A is a 2'-deoxy-2'-fluoro modified nucleotide and each B is a 2'-Omethyl modified nucleotide.

In some embodiments, the dsRNAi agent comprises the pattern of the alternating motif of 2'-O-methyl modification and 2'-F modification on the sense strand initially has a shift relative to the pattern of the alternating motif of 2'-O-methyl modification and 2'-F modification on the antisense strand initially, i.e., the 2'-O-methyl modified nucleotide on the sense strand base pairs with a 2'-F modified nucleotide on the antisense strand and vice versa. The 1 position of the sense strand may start with the 2'-F modification, and the 1 position of the antisense strand may start with the 2' methyl modification.

The introduction of one or more motifs of three identical modifications on three consecutive nucleotides to the sense strand or antisense strand interrupts the initial modification pattern present in the sense strand or antisense strand. This interruption of the modification pattern of the sense or antisense strand by introducing one or more motifs of three identical modifications on three consecutive nucleotides to the sense or antisense strand may enhance the gene silencing activity against the target gene.

In some embodiments, when the motif of three identical modifications on three consecutive nucleotides is introduced to any of the strands, the modification of the nucleotide next to the motif is a different modification than the modification of the motif. For example, the portion of the sequence containing the motif is " . . . $N_a$YYY$N_b$ . . . ," where "Y" represents the modification of the motif of three identical modifications on three consecutive nucleotide, and "$N_a$" and "$N_b$" represent a modification to the nucleotide next to the motif "YYY" that is different than the modification of Y, and where $N_a$ and $N_b$ can be the same or different modifications. Alternatively, $N_a$ or $N_b$ may be present or absent when there is a wing modification present.

The iRNA may further comprise at least one phosphorothioate or methylphosphonate internucleotide linkage. The phosphorothioate or methylphosphonate internucleotide linkage modification may occur on any nucleotide of the sense strand, antisense strand, or both strands in any position of the strand. For instance, the internucleotide linkage modification may occur on every nucleotide on the sense strand or antisense strand; each internucleotide linkage modification may occur in an alternating pattern on the sense strand or antisense strand; or the sense strand or antisense strand may contain both internucleotide linkage modifications in an alternating pattern. The alternating pattern of the internucleotide linkage modification on the sense strand may be the same or different from the antisense strand, and the alternating pattern of the internucleotide linkage modification on the sense strand may have a shift relative to the alternating pattern of the internucleotide linkage modification on the antisense strand. In one embodiment, a double-stranded RNAi agent comprises 6-8 phosphorothioate internucleotide linkages. In some embodiments, the antisense strand comprises two phosphorothioate internucleotide linkages at the 5'-end and two phosphorothioate internucleotide linkages at the 3'-end, and the sense strand comprises at least two phosphorothioate internucleotide linkages at either the 5'-end or the 3'-end.

In some embodiments, the dsRNAi agent comprises a phosphorothioate or methylphosphonate internucleotide linkage modification in the overhang region. For example, the overhang region may contain two nucleotides having a phosphorothioate or methylphosphonate internucleotide linkage between the two nucleotides. Internucleotide linkage modifications also may be made to link the overhang nucleotides with the terminal paired nucleotides within the duplex region. For example, at least 2, 3, 4, or all the overhang nucleotides may be linked through phosphorothioate or methylphosphonate internucleotide linkage, and optionally, there may be additional phosphorothioate or methylphosphonate internucleotide linkages linking the overhang nucleotide with a paired nucleotide that is next to the overhang nucleotide. For instance, there may be at least two phosphorothioate internucleotide linkages between the terminal three nucleotides, in which two of the three nucleotides are overhang nucleotides, and the third is a paired nucleotide next to the overhang nucleotide. These terminal three nucleotides may be at the 3'-end of the antisense strand, the 3'-end of the sense strand, the 5'-end of the antisense strand, or the 5' end of the antisense strand.

In some embodiments, the 2-nucleotide overhang is at the 3'-end of the antisense strand, and there are two phosphorothioate internucleotide linkages between the terminal three nucleotides, wherein two of the three nucleotides are overhang nucleotides, and the third nucleotide is a paired nucleotide next to the overhang nucleotide. Optionally, the dsRNAi agent may additionally have two phosphorothioate internucleotide linkages between the terminal three nucleotides at both the 5'-end of the sense strand and at the 5'-end of the antisense strand.

In one embodiment, the dsRNAi agent comprises mismatch(es) with the target, within the duplex, or combinations thereof. The mismatch may occur in the overhang region or the duplex region. The base pair may be ranked on the basis of their propensity to promote dissociation or melting (e.g., on the free energy of association or dissociation of a particular pairing, the simplest approach is to examine the pairs on an individual pair basis, though next neighbor or similar analysis can also be used). In terms of promoting dissociation: A:U is preferred over G:C; G:U is preferred over G:C; and I:C is preferred over G:C (I=inosine). Mismatches, e.g., non-canonical or other than canonical pairings (as described elsewhere herein) are preferred over canonical (A:T, A:U, G:C) pairings; and pairings which include a universal base are preferred over canonical pairings.

In certain embodiments, the dsRNAi agent comprises at least one of the first 1, 2, 3, 4, or 5 base pairs within the duplex regions from the 5'-end of the antisense strand independently selected from the group of: A:U, G:U, I:C, and mismatched pairs, e.g., non-canonical or other than canonical pairings or pairings which include a universal base, to promote the dissociation of the antisense strand at the 5'-end of the duplex.

In certain embodiments, the nucleotide at the 1 position within the duplex region from the 5'-end in the antisense strand is selected from A, dA, dU, U, and dT. Alternatively, at least one of the first 1, 2, or 3 base pair within the duplex region from the 5'-end of the antisense strand is an AU base pair. For example, the first base pair within the duplex region from the 5'-end of the antisense strand is an AU base pair.

In other embodiments, the nucleotide at the 3'-end of the sense strand is deoxythimidine (dT) or the nucleotide at the 3'-end of the antisense strand is deoxythimidine (dT). For example, there is a short sequence of deoxythimidine nucleotides, for example, two dT nucleotides on the 3'-end of the sense, antisense strand, or both strands.

In certain embodiments, the sense strand sequence may be represented by formula (I):

wherein:
i and j are each independently 0 or 1;
p and q are each independently 0-6;
each $N_a$ independently represents an oligonucleotide sequence comprising 0-25 modified nucleotides, each sequence comprising at least two differently modified nucleotides;
each $N_b$ independently represents an oligonucleotide sequence comprising 0-10 modified nucleotides;
each $n_p$ and $n_q$ independently represent an overhang nucleotide;
wherein $N_b$ and Y do not have the same modification; and
XXX, YYY, and ZZZ each independently represent one motif of three identical modifications on three consecutive nucleotides. In one embodiment, YYY is all 2'-F modified nucleotides.

In some embodiments, the $N_a$ or $N_b$ comprises modifications of alternating pattern.

In some embodiments, the YYY motif occurs at or near the cleavage site of the sense strand. For example, when the dsRNAi agent has a duplex region of 17-23 nucleotides in length, the YYY motif can occur at or the vicinity of the cleavage site (e.g.: can occur at positions 6, 7, 8; 7, 8, 9; 8, 9, 10; 9, 10, 11; 10, 11, 12; or 11, 12, 13) of the sense strand, the count starting from the first nucleotide, from the 5'-end; or optionally, the count starting at the first paired nucleotide within the duplex region, from the 5'-end.

In one embodiment, i is 1 and j is 0, or i is 0 and j is 1, or both i and j are 1. The sense strand can therefore be represented by the following formulas:

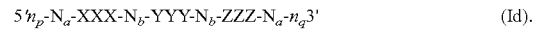

When the sense strand is represented by formula (Ib), $N_b$ represents an oligonucleotide sequence comprising 0-10, 0-7, 0-5, 0-4, 0-2, or 0 modified nucleotides. Each $N_a$ independently can represent an oligonucleotide sequence comprising 2-20, 2-15, or 2-10 modified nucleotides.

When the sense strand is represented as formula (Ic), $N_b$ represents an oligonucleotide sequence comprising 0-10, 0-7, 0-10, 0-7, 0-5, 0-4, 0-2, or 0 modified nucleotides. Each $N_a$ can independently represent an oligonucleotide sequence comprising 2-20, 2-15, or 2-10 modified nucleotides.

When the sense strand is represented as formula (Id), each $N_b$ independently represents an oligonucleotide sequence comprising 0-10, 0-7, 0-5, 0-4, 0-2, or 0 modified nucleotides. In one embodiment, $N_b$ is 0, 1, 2, 3, 4, 5, or 6 Each $N_a$ can independently represent an oligonucleotide sequence comprising 2-20, 2-15, or 2-10 modified nucleotides.

Each of X, Y and Z may be the same or different from each other.

In other embodiments, i is 0 and j is 0, and the sense strand may be represented by the formula:

When the sense strand is represented by formula (Ia), each $N_a$ independently can represent an oligonucleotide sequence comprising 2-20, 2-15, or 2-10 modified nucleotides.

In one embodiment, the antisense strand sequence of the RNAi may be represented by formula (II):

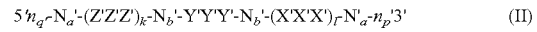

wherein:
k and l are each independently 0 or 1;
p' and q' are each independently 0-6;
each $N_a'$ independently represents an oligonucleotide sequence comprising 0-25 modified nucleotides, each sequence comprising at least two differently modified nucleotides;
each $N_b'$ independently represents an oligonucleotide sequence comprising 0-10 modified nucleotides;
each $n_p'$ and $n_q'$ independently represent an overhang nucleotide;
wherein $N_b'$ and Y' do not have the same modification; and
X'X'X', Y'Y'Y', and Z'Z'Z' each independently represent one motif of three identical modifications on three consecutive nucleotides.

In some embodiments, the $N_a'$ or $N_b'$ comprises modifications of alternating pattern.

The Y'Y'Y' motif occurs at or near the cleavage site of the antisense strand. For example, when the dsRNAi agent has a duplex region of 17-23 nucleotides in length, the Y'Y'Y' motif can occur at positions 9, 10, 11; 10, 11, 12; 11, 12, 13; 12, 13, 14; or 13, 14, 15 of the antisense strand, with the count starting from the first nucleotide, from the 5'-end; or optionally, the count starting at the first paired nucleotide within the duplex region, from the 5'-end. In one embodiment, the Y'Y'Y' motif occurs at positions 11, 12, 13.

In certain embodiments, Y'Y'Y' motif is all 2'-OMe modified nucleotides.

In certain embodiments, k is 1 and l is 0, or k is 0 and l is 1, or both k and l are 1.

The antisense strand can therefore be represented by the following formulas:

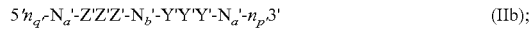  (IIb);

  (IIc); or

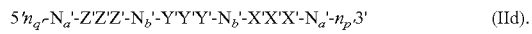  (IId).

When the antisense strand is represented by formula (IIb), $N_b'$ represents an oligonucleotide sequence comprising 0-10, 0-7, 0-10, 0-7, 0-5, 0-4, 0-2, or 0 modified nucleotides. Each $N_a'$ independently represents an oligonucleotide sequence comprising 2-20, 2-15, or 2-10 modified nucleotides.

When the antisense strand is represented as formula (IIc), $N_b'$ represents an oligonucleotide sequence comprising 0-10, 0-7, 0-10, 0-7, 0-5, 0-4, 0-2, or 0 modified nucleotides. Each $N_a'$ independently represents an oligonucleotide sequence comprising 2-20, 2-15, or 2-10 modified nucleotides.

When the antisense strand is represented as formula (IId), each $N_b'$ independently represents an oligonucleotide sequence comprising 0-10, 0-7, 0-10, 0-7, 0-5, 0-4, 0-2, or 0 modified nucleotides. Each $N_a'$ independently represents an oligonucleotide sequence comprising 2-20, 2-15, or 2-10 modified nucleotides. In one embodiment, $N_b$ is 0, 1, 2, 3, 4, 5, or 6.

In other embodiments, k is 0 and l is 0 and the antisense strand may be represented by the formula:

  (Ia).

When the antisense strand is represented as formula (IIa), each $N_a'$ independently represents an oligonucleotide sequence comprising 2-20, 2-15, or 2-10 modified nucleotides. Each of X', Y' and Z' may be the same or different from each other.

Each nucleotide of the sense strand and antisense strand may be independently modified with LNA, CRN, UNA, cEt, HNA, CeNA, 2'-methoxyethyl, 2'-O-methyl, 2'-O-allyl, 2'-C-allyl, 2'-hydroxyl, or 2'-fluoro. For example, each nucleotide of the sense strand and antisense strand is independently modified with 2'-O-methyl or 2'-fluoro. Each X, Y, Z, X', Y', and Z', in particular, may represent a 2'-O-methyl modification or a 2'-fluoro modification.

In some embodiments, the sense strand of the dsRNAi agent may contain YYY motif occurring at 9, 10, and 11 positions of the strand when the duplex region is 21 nt, the count starting from the first nucleotide from the 5'-end, or optionally, the count starting at the first paired nucleotide within the duplex region, from the 5'-end; and Y represents 2'-F modification. The sense strand may additionally contain XXX motif or ZZZ motifs as wing modifications at the opposite end of the duplex region; and XXX and ZZZ each independently represents a 2'-OMe modification or 2'-F modification.

In some embodiments the antisense strand may contain Y'Y'Y' motif occurring at positions 11, 12, 13 of the strand, the count starting from the first nucleotide from the 5'-end, or optionally, the count starting at the first paired nucleotide within the duplex region, from the 5'-end; and Y' represents 2'-O-methyl modification. The antisense strand may additionally contain X'X'X' motif or Z'Z'Z' motifs as wing modifications at the opposite end of the duplex region; and X'X'X' and Z'Z'Z' each independently represents a 2'-OMe modification or 2'-F modification.

The sense strand represented by any one of the above formulas (Ia), (Ib), (Ic), and (Id) forms a duplex with an antisense strand being represented by any one of formulas (IIa), (IIb), (IIc), and (IId), respectively.

Accordingly, the dsRNAi agents for use in the methods of the invention may comprise a sense strand and an antisense strand, each strand having 14 to 30 nucleotides, the iRNA duplex represented by formula (III):

sense: 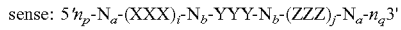

antisense: 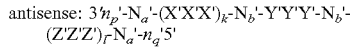  (III)

wherein:
j, k, and l are each independently 0 or 1;
p, p', q, and q' are each independently 0-6;
each $N_a$ and $N_a'$ independently represents an oligonucleotide sequence comprising 0-25 modified nucleotides, each sequence comprising at least two differently modified nucleotides;
each $N_b$ and $N_b'$ independently represents an oligonucleotide sequence comprising 0-10 modified nucleotides;
wherein each $n_p'$, $n_p$, $n_q'$, and $n_q$, each of which may or may not be present, independently represents an overhang nucleotide; and
XXX, YYY, ZZZ, X'X'X', Y'Y'Y', and Z'Z'Z' each independently represent one motif of three identical modifications on three consecutive nucleotides.

In one embodiment, i is 0 and j is 0; or i is 1 and j is 0; or i is 0 and j is 1; or both i and j are 0; or both i and j are 1. In another embodiment, k is 0 and l is 0; or k is 1 and l is 0; k is 0 and l is 1; or both k and l are 0; or both k and l are 1.

Exemplary combinations of the sense strand and antisense strand forming an iRNA duplex include the formulas below:

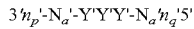  (IIIa)

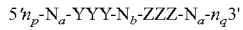

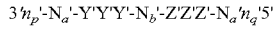  (IIIb)

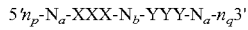

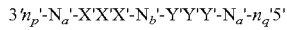  (IIIc)

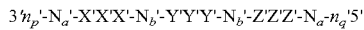  (IIId)

When the dsRNAi agent is represented by formula (IIIa), each $N_a$ independently represents an oligonucleotide sequence comprising 2-20, 2-15, or 2-10 modified nucleotides.

When the dsRNAi agent is represented by formula (IIIb), each $N_b$ independently represents an oligonucleotide sequence comprising 1-10, 1-7, 1-5, or 1-4 modified nucleotides. Each $N_a$ independently represents an oligonucleotide sequence comprising 2-20, 2-15, or 2-10 modified nucleotides.

When the dsRNAi agent is represented as formula (IIIc), each $N_b$, $N_b'$ independently represents an oligonucleotide sequence comprising 0-10, 0-7, 0-10, 0-7, 0-5, 0-4, 0-2, or 0 modified nucleotides. Each $N_a$ independently represents an oligonucleotide sequence comprising 2-20, 2-15, or 2-10 modified nucleotides.

When the dsRNAi agent is represented as formula (IIId), each $N_b$, $N_b'$ independently represents an oligonucleotide sequence comprising 0-10, 0-7, 0-10, 0-7, 0-5, 0-4, 0-2, or 0 modified nucleotides. Each $N_a$, $N_a'$ independently represents an oligonucleotide sequence comprising 2-20, 2-15, or 2-10 modified nucleotides. Each of $N_a$, $N_a'$, $N_b$, and $N_b'$ independently comprises modifications of alternating pattern.

Each of X, Y, and Z in formulas (III), (IIIa), (IIIb), (IIIc), and (IIId) may be the same or different from each other.

When the dsRNAi agent is represented by formula (III), (IIIa), (IIIb), (IIIc), and (IIId), at least one of the Y nucleotides may form a base pair with one of the Y' nucleotides. Alternatively, at least two of the Y nucleotides form base pairs with the corresponding Y' nucleotides; or all three of the Y nucleotides all form base pairs with the corresponding Y' nucleotides.

When the dsRNAi agent is represented by formula (IIIb) or (IIId), at least one of the Z nucleotides may form a base pair with one of the Z' nucleotides. Alternatively, at least two of the Z nucleotides form base pairs with the corresponding Z' nucleotides; or all three of the Z nucleotides all form base pairs with the corresponding Z' nucleotides.

When the dsRNAi agent is represented as formula (IIIc) or (IIId), at least one of the X nucleotides may form a base pair with one of the X' nucleotides. Alternatively, at least two of the X nucleotides form base pairs with the corresponding X' nucleotides; or all three of the X nucleotides all form base pairs with the corresponding X' nucleotides.

In certain embodiments, the modification on the Y nucleotide is different than the modification on the Y' nucleotide, the modification on the Z nucleotide is different than the modification on the Z' nucleotide, or the modification on the X nucleotide is different than the modification on the X' nucleotide.

In certain embodiments, when the dsRNAi agent is represented by formula (IIId), the $N_a$ modifications are 2'-O-methyl or 2'-fluoro modifications. In other embodiments, when the RNAi agent is represented by formula (IIId), the $N_a$ modifications are 2'-O-methyl or 2'-fluoro modifications and $n_p'>0$ and at least one $n_p'$ is linked to a neighboring nucleotide a via phosphorothioate linkage. In yet other embodiments, when the RNAi agent is represented by formula (IIId), the $N_a$ modifications are 2'-O-methyl or 2'-fluoro modifications, $n_p'>0$ and at least one $n_p'$ is linked to a neighboring nucleotide via phosphorothioate linkage, and the sense strand is conjugated to one or more GalNAc derivatives attached through a bivalent or trivalent branched linker (described below). In other embodiments, when the RNAi agent is represented by formula (IIId), the $N_a$ modifications are 2'40-methyl or 2'-fluoro modifications, $n_p'>0$ and at least one $n_p'$ is linked to a neighboring nucleotide via phosphorothioate linkage, the sense strand comprises at least one phosphorothioate linkage, and the sense strand is conjugated to one or more GalNAc derivatives attached through a bivalent or trivalent branched linker.

In some embodiments, when the dsRNAi agent is represented by formula (IIIa), the $N_a$ modifications are 2'-O-methyl or 2'-fluoro modifications, $n_p'>0$ and at least one $n_p'$ is linked to a neighboring nucleotide via phosphorothioate linkage, the sense strand comprises at least one phosphorothioate linkage, and the sense strand is conjugated to one or more GalNAc derivatives attached through a bivalent or trivalent branched linker.

In some embodiments, the dsRNAi agent is a multimer containing at least two duplexes represented by formula (III), (IIIa), (IIIb), (IIIc), and (IIId), wherein the duplexes are connected by a linker. The linker can be cleavable or non-cleavable. Optionally, the multimer further comprises a ligand. Each of the duplexes can target the same gene or two different genes; or each of the duplexes can target same gene at two different target sites.

In some embodiments, the dsRNAi agent is a multimer containing three, four, five, six, or more duplexes represented by formula (III), (IIIa), (IIIb), (IIIc), and (IIId), wherein the duplexes are connected by a linker. The linker can be cleavable or non-cleavable. Optionally, the multimer further comprises a ligand. Each of the duplexes can target the same gene or two different genes; or each of the duplexes can target same gene at two different target sites.

In one embodiment, two dsRNAi agents represented by at least one of formulas (III), (IIIa), (IIIb), (IIIc), and (IIId) are linked to each other at the 5' end, and one or both of the 3' ends, and are optionally conjugated to a ligand. Each of the agents can target the same gene or two different genes; or each of the agents can target same gene at two different target sites.

In certain embodiments, an RNAi agent of the invention may contain a low number of nucleotides containing a 2'-fluoro modification, e.g., 10 or fewer nucleotides with 2'-fluoro modification. For example, the RNAi agent may contain 10, 9, 8, 7, 6, 5, 4, 3, 2, 1 or 0 nucleotides with a 2'-fluoro modification. In a specific embodiment, the RNAi agent of the invention contains 10 nucleotides with a 2'-fluoro modification, e.g., 4 nucleotides with a 2'-fluoro modification in the sense strand and 6 nucleotides with a 2'-fluoro modification in the antisense strand. In another specific embodiment, the RNAi agent of the invention contains 6 nucleotides with a 2'-fluoro modification, e.g., 4 nucleotides with a 2'-fluoro modification in the sense strand and 2 nucleotides with a 2'-fluoro modification in the antisense strand.

In other embodiments, an RNAi agent of the invention may contain an ultra low number of nucleotides containing a 2'-fluoro modification, e.g., 2 or fewer nucleotides containing a 2'-fluoro modification. For example, the RNAi agent may contain 2, 1 of 0 nucleotides with a 2'-fluoro modification. In a specific embodiment, the RNAi agent may contain 2 nucleotides with a 2'-fluoro modification, e.g., 0 nucleotides with a 2-fluoro modification in the sense strand and 2 nucleotides with a 2'-fluoro modification in the antisense strand.

Various publications describe multimeric iRNAs that can be used in the methods of the invention. Such publications include WO2007/091269, U.S. Pat. No. 7,858,769, WO2010/141511, WO2007/117686, WO2009/014887, and WO2011/031520 the entire contents of each of which are hereby incorporated herein by reference.

In certain embodiments, the compositions and methods of the disclosure include a vinyl phosphonate (VP) modification of an RNAi agent as described herein. In exemplary embodiments, a 5' vinyl phosphonate modified nucleotide of the disclosure has the structure:

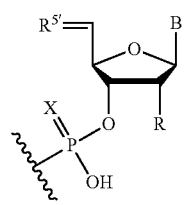

wherein X is O or S;
R is hydrogen, hydroxy, fluoro, or $C_{1-20}$alkoxy (e.g., methoxy or n-hexadecyloxy);

R5' is =C(H)—P(O)(OH)$_2$ and the double bond between the C5' carbon and R5' is in the E or Z orientation (e.g., E orientation); and B is a nucleobase or a modified nucleobase, optionally where B is adenine, guanine, cytosine, thymine, or uracil.

A vinyl phosphonate of the instant disclosure may be attached to either the antisense or the sense strand of a dsRNA of the disclosure. In certain embodiments, a vinyl phosphonate of the instant disclosure is attached to the antisense strand of a dsRNA, optionally at the 5' end of the antisense strand of the dsRNA.

Vinyl phosphate modifications are also contemplated for the compositions and methods of the instant disclosure. An exemplary vinyl phosphate structure includes the preceding structure, where R5' is =C(H)—OP(O)(OH)2 and the double bond between the C5' carbon and R5' is in the E or Z orientation (e.g., E orientation).

As described in more detail below, the iRNA that contains conjugations of one or more carbohydrate moieties to an iRNA can optimize one or more properties of the iRNA. In many cases, the carbohydrate moiety will be attached to a modified subunit of the iRNA. For example, the ribose sugar of one or more ribonucleotide subunits of a iRNA can be replaced with another moiety, e.g., a non-carbohydrate (such as, cyclic) carrier to which is attached a carbohydrate ligand. A ribonucleotide subunit in which the ribose sugar of the subunit has been so replaced is referred to herein as a ribose replacement modification subunit (RRMS). A cyclic carrier may be a carbocyclic ring system, i.e., all ring atoms are carbon atoms, or a heterocyclic ring system, i.e., one or more ring atoms may be a heteroatom, e.g., nitrogen, oxygen, sulfur. The cyclic carrier may be a monocyclic ring system, or may contain two or more rings, e.g. fused rings. The cyclic carrier may be a fully saturated ring system, or it may contain one or more double bonds.

The ligand may be attached to the polynucleotide via a carrier. The carriers include (i) at least one "backbone attachment point," such as, two "backbone attachment points" and (ii) at least one "tethering attachment point." A "backbone attachment point" as used herein refers to a functional group, e.g. a hydroxyl group, or generally, a bond available for, and that is suitable for incorporation of the carrier into the backbone, e.g., the phosphate, or modified phosphate, e.g., sulfur containing, backbone, of a ribonucleic acid. A "tethering attachment point" (TAP) in some embodiments refers to a constituent ring atom of the cyclic carrier, e.g., a carbon atom or a heteroatom (distinct from an atom which provides a backbone attachment point), that connects a selected moiety. The moiety can be, e.g., a carbohydrate, e.g. monosaccharide, disaccharide, trisaccharide, tetrasaccharide, oligosaccharide, or polysaccharide. Optionally, the selected moiety is connected by an intervening tether to the cyclic carrier. Thus, the cyclic carrier will often include a functional group, e.g., an amino group, or generally, provide a bond, that is suitable for incorporation or tethering of another chemical entity, e.g., a ligand to the constituent ring.

The iRNA may be conjugated to a ligand via a carrier, wherein the carrier can be cyclic group or acyclic group. In one embodiment, the cyclic group is selected from pyrrolidinyl, pyrazolinyl, pyrazolidinyl, imidazolinyl, imidazolidinyl, piperidinyl, piperazinyl, [1,3]dioxolane, oxazolidinyl, isoxazolidinyl, morpholinyl, thiazolidinyl, isothiazolidinyl, quinoxalinyl, pyridazinonyl, tetrahydrofuryl, and decalin. In one embodiment, the acyclic group is a serinol backbone or diethanolamine backbone.

i. Thermally Destabilizing Modifications

In certain embodiments, a dsRNA molecule can be optimized for RNA interference by incorporating thermally destabilizing modifications in the seed region of the antisense strand. As used herein "seed region" means at positions 2-9 of the 5'-end of the referenced strand. For example, thermally destabilizing modifications can be incorporated in the seed region of the antisense strand to reduce or inhibit off-target gene silencing.

The term "thermally destabilizing modification(s)" includes modification(s) that would result with a dsRNA with a lower overall melting temperature ($T_m$) than the $T_m$ of the dsRNA without having such modification(s). For example, the thermally destabilizing modification(s) can decrease the $T_m$ of the dsRNA by 1-4° C., such as one, two, three or four degrees Celcius. And, the term "thermally destabilizing nucleotide" refers to a nucleotide containing one or more thermally destabilizing modifications.

It has been discovered that dsRNAs with an antisense strand comprising at least one thermally destabilizing modification of the duplex within the first 9 nucleotide positions, counting from the 5' end, of the antisense strand have reduced off-target gene silencing activity. Accordingly, in some embodiments, the antisense strand comprises at least one (e.g., one, two, three, four, five or more) thermally destabilizing modification of the duplex within the first 9 nucleotide positions of the 5' region of the antisense strand. In some embodiments, one or more thermally destabilizing modification(s) of the duplex is/are located in positions 2-9, such as, positions 4-8, from the 5'-end of the antisense strand. In some further embodiments, the thermally destabilizing modification(s) of the duplex is/are located at position 6, 7 or 8 from the 5'-end of the antisense strand. In still some further embodiments, the thermally destabilizing modification of the duplex is located at position 7 from the 5'-end of the antisense strand. In some embodiments, the thermally destabilizing modification of the duplex is located at position 2, 3, 4, 5 or 9 from the 5'-end of the antisense strand.

An iRNA agent comprises a sense strand and an antisense strand, each strand having 14 to 40 nucleotides. The RNAi agent may be represented by formula (L):

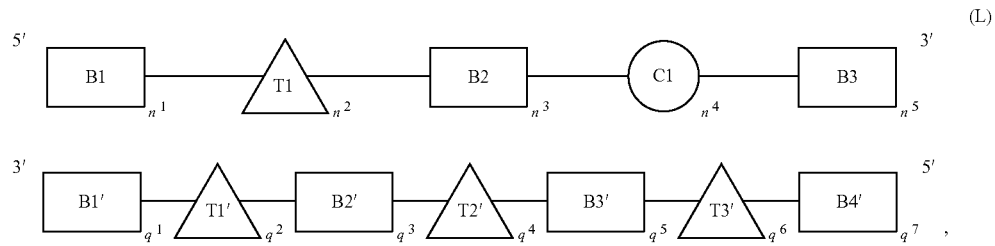

In formula (L), B1, B2, B3, B1', B2', B3', and κ4' each are independently a nucleotide containing a modification selected from the group consisting of 2'-O-alkyl, 2'-substituted alkoxy, 2'-substituted alkyl, 2'-halo, ENA, and BNA/LNA. In one embodiment, B1, B2, B3, B1', B2', B3', and B4' each contain 2'-OMe modifications. In one embodiment, B1, B2, B3, B1', B2', B3', and B4' each contain 2'-OMe or 2'-F modifications. In one embodiment, at least one of B1, B2, B3, B1', B2', B3', and B4' contain 2'-O—N-methylacetamido (2'-O-NMA, 2'O—CH$_2$C(O)N(Me)H) modification.

C1 is a thermally destabilizing nucleotide placed at a site opposite to the seed region of the antisense strand (i.e., at positions 2-8 of the 5'-end of the antisense strand). For example, C1 is at a position of the sense strand that pairs with a nucleotide at positions 2-8 of the 5'-end of the antisense strand. In one example, C1 is at position 15 from the 5'-end of the sense strand. C1 nucleotide bears the thermally destabilizing modification which can include abasic modification; mismatch with the opposing nucleotide in the duplex; and sugar modification such as 2'-deoxy modification or acyclic nucleotide e.g., unlocked nucleic acids (UNA) or glycerol nucleic acid (GNA) or 2'-5'-linked ribonucleotides ("3'-RNA"). In one embodiment, C1 has thermally destabilizing modification selected from the group consisting of: i) mismatch with the opposing nucleotide in the antisense strand; ii) abasic modification selected from the group consisting of:

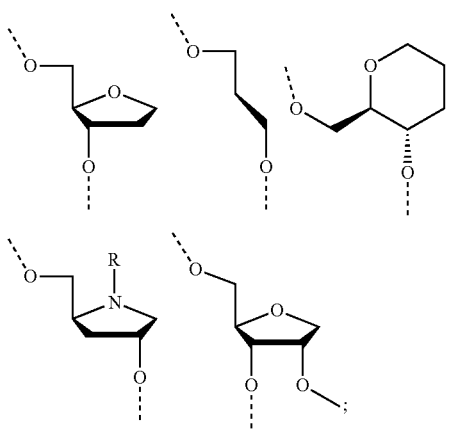

and iii) sugar modification selected from the group consisting of:

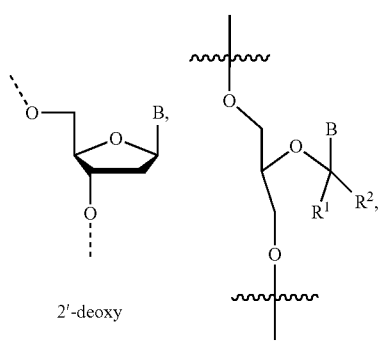

2'-deoxy

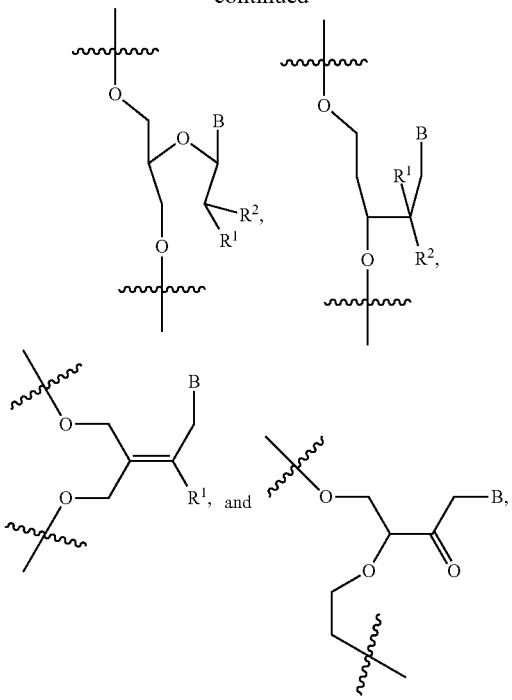

wherein B is a modified or unmodified nucleobase, $R^1$ and $R^2$ independently are H, halogen, $OR_3$, or alkyl; and R3 is H, alkyl, cycloalkyl, aryl, aralkyl, heteroaryl or sugar. In one embodiment, the thermally destabilizing modification in C1 is a mismatch selected from the group consisting of G:G, G:A, G:U, G:T, A:A, A:C, C:C, C:U, C:T, U:U, T:T, and U:T; and optionally, at least one nucleobase in the mismatch pair is a 2'-deoxy nucleobase. In one example, the thermally destabilizing modification in C1 is GNA or

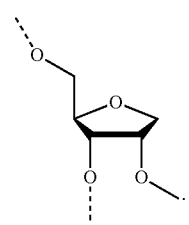

T1, T1', T2', and T3' each independently represent a nucleotide comprising a modification providing the nucleotide a steric bulk that is less or equal to the steric bulk of a 2'-OMe modification. A steric bulk refers to the sum of steric effects of a modification. Methods for determining steric effects of a modification of a nucleotide are known to one skilled in the art. The modification can be at the 2' position of a ribose sugar of the nucleotide, or a modification to a non-ribose nucleotide, acyclic nucleotide, or the backbone of the nucleotide that is similar or equivalent to the 2' position of the ribose sugar, and provides the nucleotide a steric bulk that is less than or equal to the steric bulk of a 2'-OMe modification. For example, T1, T1', T2', and T3' are each independently selected from DNA, RNA, LNA, 2'-F, and 2'-F-5'-methyl. In one embodiment, T1 is DNA. In one embodiment, T1' is DNA, RNA or LNA.

In one embodiment, T2' is DNA or RNA. In one embodiment, T3' is DNA or RNA.

$n^1$, $n^3$, and $q^1$ are independently 4 to 15 nucleotides in length.

$n^5$, $q^3$, and $q^7$ are independently 1-6 nucleotide(s) in length.

$n^4$, $q^2$, and $q^6$ are independently 1-3 nucleotide(s) in length; alternatively, $n^4$ is 0.

$q^5$ is independently 0-10 nucleotide(s) in length.

$n^2$ and $q^4$ are independently 0-3 nucleotide(s) in length. Alternatively, $n^4$ is 0-3 nucleotide(s) in length.

In one embodiment, $n^4$ can be 0. In one example, $n^4$ is 0, and $q^2$ and $q^6$ are 1. In another example, $n^4$ is 0, and $q^2$ and $q^6$ are 1, with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand).

In one embodiment, $n^4$, $q^2$, and $q^6$ are each 1.

In one embodiment, $n^2$, $n^4$, $q^2$, $q^4$, and $q^6$ are each 1.

In one embodiment, C1 is at position 14-17 of the 5'-end of the sense strand, when the sense strand is 19-22 nucleotides in length, and $n^4$ is 1. In one embodiment, C1 is at position 15 of the 5'-end of the sense strand In one embodiment, T3' starts at position 2 from the 5' end of the antisense strand. In one example, T3' is at position 2 from the 5' end of the antisense strand and $q^6$ is equal to 1. In one embodiment, T1' starts at position 14 from the 5' end of the antisense strand. In one example, T1' is at position 14 from the 5' end of the antisense strand and $q^2$ is equal to 1.

In an exemplary embodiment, T3' starts from position 2 from the 5' end of the antisense strand and T1' starts from position 14 from the 5' end of the antisense strand. In one example, T3' starts from position 2 from the 5' end of the antisense strand and $q^6$ is equal to 1 and T1' starts from position 14 from the 5' end of the antisense strand and $q^2$ is equal to 1.

In one embodiment, T1' and T3' are separated by 11 nucleotides in length (i.e. not counting the T1' and T3' nucleotides).

In one embodiment, T1' is at position 14 from the 5' end of the antisense strand. In one example, T1' is at position 14 from the 5' end of the antisense strand and $q^2$ is equal to 1, and the modification at the 2' position or positions in a non-ribose, acyclic or backbone that provide less steric bulk than a 2'-OMe ribose.

In one embodiment, T3' is at position 2 from the 5' end of the antisense strand. In one example, T3' is at position 2 from the 5' end of the antisense strand and $q^6$ is equal to 1, and the modification at the 2' position or positions in a non-ribose, acyclic or backbone that provide less than or equal to steric bulk than a 2'-OMe ribose.

In one embodiment, T1 is at the cleavage site of the sense strand. In one example, T1 is at position 11 from the 5' end of the sense strand, when the sense strand is 19-22 nucleotides in length, and $n^2$ is 1. In an exemplary embodiment, T1 is at the cleavage site of the sense strand at position 11 from the 5' end of the sense strand, when the sense strand is 19-22 nucleotides in length, and $n^2$ is 1, In one embodiment, T2' starts at position 6 from the 5' end of the antisense strand. In one example, T2' is at positions 6-10 from the 5' end of the antisense strand, and $q^4$ is 1.

In an exemplary embodiment, T1 is at the cleavage site of the sense strand, for instance, at position 11 from the 5' end of the sense strand, when the sense strand is 19-22 nucleotides in length, and $n^2$ is 1; T1' is at position 14 from the 5' end of the antisense strand, and $q^2$ is equal to 1, and the modification to T1' is at the 2' position of a ribose sugar or at positions in a non-ribose, acyclic or backbone that provide less steric bulk than a 2'-OMe ribose; T2' is at positions 6-10 from the 5' end of the antisense strand, and $q^4$ is 1; and T3' is at position 2 from the 5' end of the antisense strand, and $q^6$ is equal to 1, and the modification to T3' is at the 2' position or at positions in a non-ribose, acyclic or backbone that provide less than or equal to steric bulk than a 2'-OMe ribose.

In one embodiment, T2' starts at position 8 from the 5' end of the antisense strand. In one example, T2' starts at position 8 from the 5' end of the antisense strand, and $q^4$ is 2.

In one embodiment, T2' starts at position 9 from the 5' end of the antisense strand. In one example, T2' is at position 9 from the 5' end of the antisense strand, and $q^4$ is 1.

In one embodiment, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 1, B3' is 2'-OMe or 2'-F, $q^5$ is 6, T3' is 2'-F, $q^6$ is 1, B4' is 2'-OMe, and $q^7$ is 1; with two phosphorothioate internucleotide linkage modifications within positions 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand).

In one embodiment, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 1, B3' is 2'-OMe or 2'-F, $q^5$ is 6, T3' is 2'-F, $q^6$ is 1, B4' is 2'-OMe, and $q^7$ is 1; with two phosphorothioate internucleotide linkage modifications within positions 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand).

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, BF is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1; with two phosphorothioate internucleotide linkage modifications within positions 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand).

In one embodiment, B1 is 2'-OMe or 2'-F, $n^1$ is 6, T1 is 2'F, $n^2$ is 3, B2 is 2'-OMe, $n^3$ is 7, $n^4$ is 0, B3 is 2'OMe, $n^5$ is 3, BF is 2'-OMe or 2'-F, $q^1$ is 7, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1.

In one embodiment, B1 is 2'-OMe or 2'-F, $n^1$ is 6, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 7, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1; with two phosphorothioate internucleotide linkage modifications within positions 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand).

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, BF is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 1, B3' is 2'-OMe or 2'-F, $q^5$ is 6, T3' is 2'-F, $q^6$ is 1, B4' is 2'-OMe, and $q^7$ is 1.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 1, B3' is 2'-OMe or 2'-F, $q^5$ is 6, T3' is 2'-F, $q^6$ is 1, B4' is 2'-OMe, and $q^7$ is 1; with two phosphorothioate internucleotide linkage modifications within positions 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand).

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, BF is 2'-OMe or 2'-F, $q^1$ is 9, T1' is 2'-F, $q^2$ is 1, B2' is 2'-OMe or 2'-F, $q^3$ is 5, T2' is 2'-F, $q^4$ is 1, B3' is 2'-OMe or 2'-F, $q^5$ is 5, T3' is 2'-F, $q^6$ is 1, B4' is 2'-OMe, and $q^7$ is 1; optionally with at least 2 additional TT at the 3'-end of the antisense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'-F, $q^3$ is 5, T2' is 2'-F, $q^4$ is 1, B3' is 2'-OMe or 2'-F, $q^5$ is 5, T3' is 2'-F, $q^6$ is 1, B4' is 2'-OMe, and $q^7$ is 1; optionally with at least 2 additional TT at the 3'-end of the antisense strand; with two phosphorothioate internucleotide linkage modifications within positions 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand).

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1; with two phosphorothioate internucleotide linkage modifications within positions 1-5 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end).

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, BF is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1; with two phosphorothioate internucleotide linkage modifications within positions 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand).

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1; with two phosphorothioate internucleotide linkage modifications within positions 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand).

The RNAi agent can comprise a phosphorus-containing group at the 5'-end of the sense strand or antisense strand. The 5'-end phosphorus-containing group can be 5'-end phosphate (5'-P), 5'-end phosphorothioate (5'-PS), 5'-end phosphorodithioate (5'-PS$_2$), 5'-end vinylphosphonate (5'-VP), 5'-end methylphosphonate (MePhos), or 5'-deoxy-5'-C-malonyl

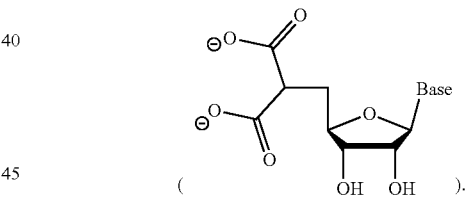

When the 5'-end phosphorus-containing group is 5'-end vinylphosphonate (5'-VP), the 5'-VP can be either 5'-E-VP isomer (i.e., trans-vinylphosphate,

5'-Z-VP isomer (i.e., cis-vinylphosphate, or mixtures thereof.

In one embodiment, the RNAi agent comprises a phosphorus-containing group at the 5'-end of the sense strand. In one embodiment, the RNAi agent comprises a phosphorus-containing group at the 5'-end of the antisense strand.

In one embodiment, the RNAi agent comprises a 5'-P. In one embodiment, the RNAi agent comprises a 5'-P in the antisense strand.

In one embodiment, the RNAi agent comprises a 5'-PS. In one embodiment, the RNAi agent comprises a 5'-PS in the antisense strand.

In one embodiment, the RNAi agent comprises a 5'-VP. In one embodiment, the RNAi agent comprises a 5'-VP in the antisense strand. In one embodiment, the RNAi agent comprises a 5'-E-VP in the antisense strand. In one embodiment, the RNAi agent comprises a 5'-Z-VP in the antisense strand.

In one embodiment, the RNAi agent comprises a 5'-PS$_2$. In one embodiment, the RNAi agent comprises a 5'-PS$_2$ in the antisense strand.

In one embodiment, the RNAi agent comprises a 5'-PS$_2$. In one embodiment, the RNAi agent comprises a 5'-deoxy-5'-C-malonyl in the antisense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, BF is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1. The RNAi agent also comprises a 5'-PS.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, BF is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1. The RNAi agent also comprises a 5'-P.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, BF is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1. The RNAi agent also comprises a 5'-VP. The 5'-VP may be 5'-E-VP, 5'-Z-VP, or combination thereof.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, BF is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1. The RNAi agent also comprises a 5'-PS$_2$.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, BF is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1. The RNAi agent also comprises a 5'-deoxy-5'-C-malonyl.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-P.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-PS.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-VP. The 5'-VP may be 5'-E-VP, 5'-Z-VP, or combination thereof.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-PS$_2$.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-deoxy-5'-C-malonyl.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1. The RNAi agent also comprises a 5'-P.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1. The dsRNA agent also comprises a 5'-PS.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1. The RNAi agent also comprises a 5'-VP. The 5'-VP may be 5'-E-VP, 5'-Z-VP, or combination thereof. In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1. The RNAi agent also comprises a 5'-PS$_2$.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1. The RNAi agent also comprises a 5'-deoxy-5'-C-malonyl.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1; with two phosphorothioate internucleotide linkage modifications within position 1-5 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end). The RNAi agent also comprises a 5'-P.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1; with two phosphorothioate internucleotide linkage modifications within position 1-5 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end). The RNAi agent also comprises a 5'-PS.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1; with two phosphorothioate internucleotide linkage modifications within position 1-5 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end). The RNAi agent also comprises a 5'-VP. The 5'-VP may be 5'-E-VP, 5'-Z-VP, or combination thereof.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1; with two phosphorothioate internucleotide linkage modifications within position 1-5 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end). The RNAi agent also comprises a 5'-PS$_2$.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1; with two phosphorothioate internucleotide linkage modifications within position 1-5 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end). The RNAi agent also comprises a 5'-deoxy-5'-C-malonyl.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, BF is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1. The RNAi agent also comprises a 5'-P.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, BF is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1. The RNAi agent also comprises a 5'-PS.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, BF is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1. The RNAi agent also comprises a 5'-VP. The 5'-VP may be 5'-E-VP, 5'-Z-VP, or combination thereof.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, BF is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1. The dsRNAi RNA agent also comprises a 5'-PS$_2$.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, BF is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1. The RNAi agent also comprises a 5'-deoxy-5'-C-malonyl.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-P.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-PS.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-VP. The 5'-VP may be 5'-E-VP, 5'-Z-VP, or combination thereof.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-PS$_2$.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-deoxy-5'-C-malonyl.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1. The RNAi agent also comprises a 5'-P.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1. The RNAi agent also comprises a 5'-PS.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1. The RNAi agent also comprises a 5'-VP. The 5'-VP may be 5'-E-VP, 5'-Z-VP, or combination thereof.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1. The RNAi agent also comprises a 5'-PS$_2$.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1. The RNAi agent also comprises a 5'-deoxy-5'-C-malonyl.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-P.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-PS.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-VP. The 5'-VP may be 5'-E-VP, 5'-Z-VP, or combination thereof.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-PS$_2$.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-deoxy-5'-C-malonyl.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-P and a targeting ligand. In one embodiment, the 5'-P is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-PS and a targeting ligand. In one embodiment, the 5'-PS is at the 5'-end of the antisense strand, and the targeting ligand is at the 3'-end of the sense strand. In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-VP (e.g., a 5'-E-VP, 5'-Z-VP, or combination thereof), and a targeting ligand.

In one embodiment, the 5'-VP is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-PS$_2$ and a targeting ligand. In one embodiment, the 5'-PS$_2$ is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-deoxy-5'-C-malonyl and a targeting ligand. In one embodiment, the 5'-deoxy-5'-C-malonyl is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1; with two phosphorothioate internucleotide linkage modifications within position 1-5 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end). The RNAi agent also comprises a 5'-P and a targeting ligand. In one embodiment, the 5'-P is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1; with two phosphorothioate internucleotide linkage modifications within position 1-5 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end). The RNAi agent also comprises a 5'-PS and a targeting ligand. In one embodiment, the 5'-PS is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1; with two phosphorothioate internucleotide linkage modifications within position 1-5 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end). The RNAi agent also comprises a 5'-VP (e.g., a 5'-E-VP, 5'-Z-VP, or combination thereof) and a targeting ligand. In one embodiment, the 5'-VP is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1; with two phosphorothioate internucleotide linkage modifications within position 1-5 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end). The RNAi agent also comprises a 5'-PS$_2$ and a targeting ligand. In one embodiment, the 5'-PS$_2$ is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1; with two phosphorothioate internucleotide linkage modifications within position 1-5 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end). The RNAi agent also comprises a 5'-deoxy-5'-C-malonyl and a targeting ligand. In one embodiment, the 5'-deoxy-5'-C-malonyl is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1;

with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-P and a targeting ligand. In one embodiment, the 5'-P is at the 5'-end of the antisense strand, and the targeting ligand is at the 3'-end of the sense strand. In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-PS and a targeting ligand. In one embodiment, the 5'-PS is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-VP (e.g., a 5'-E-VP, 5'-Z-VP, or combination thereof) and a targeting ligand. In one embodiment, the 5'-VP is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-PS$_2$ and a targeting ligand. In one embodiment, the 5'-PS$_2$ is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, BF is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1;

with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-deoxy-5'-C-malonyl and a targeting ligand. In one embodiment, the 5'-deoxy-5'-C-malonyl is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-P and a targeting ligand. In one embodiment, the 5'-P is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-PS and a targeting ligand. In one embodiment, the 5'-PS is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-VP (e.g., a 5'-E-VP, 5'-Z-VP, or combination thereof) and a targeting ligand. In one embodiment, the 5'-VP is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-PS$_2$ and a targeting ligand. In one embodiment, the 5'-PS$_2$ is at the 5'-end of the antisense strand, and the targeting ligand is at the 3'-end of the sense strand. In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-deoxy-5'-C-malonyl and a targeting ligand. In one embodiment, the 5'-deoxy-5'-C-malonyl is at the 5'-end of the antisense strand, and the targeting ligand is at the 3'-end of the sense strand.

In a particular embodiment, an RNAi agent of the present invention comprises:

(a) a sense strand having:
 (i) a length of 21 nucleotides;
 (ii) an ASGPR ligand attached to the 3'-end, wherein said ASGPR ligand comprises three GalNAc derivatives attached through a trivalent branched linker; and
 (iii) 2'-F modifications at positions 1, 3, 5, 7, 9 to 11, 13, 17, 19, and 21, and 2'-OMe modifications at positions 2, 4, 6, 8, 12, 14 to 16, 18, and 20 (counting from the 5' end);
and
(b) an antisense strand having:
 (i) a length of 23 nucleotides;
 (ii) 2'-OMe modifications at positions 1, 3, 5, 9, 11 to 13, 15, 17, 19, 21, and 23, and 2'F modifications at positions 2, 4, 6 to 8, 10, 14, 16, 18, 20, and 22 (counting from the 5' end); and
 (iii) phosphorothioate internucleotide linkages between nucleotide positions 21 and 22, and between nucleotide positions 22 and 23 (counting from the 5' end);
wherein the dsRNA agents have a two nucleotide overhang at the 3'-end of the antisense strand, and a blunt end at the 5'-end of the antisense strand.

In another particular embodiment, an RNAi agent of the present invention comprises:

(a) a sense strand having:
 (i) a length of 21 nucleotides;
 (ii) an ASGPR ligand attached to the 3'-end, wherein said ASGPR ligand comprises three GalNAc derivatives attached through a trivalent branched linker;
 (iii) 2'-F modifications at positions 1, 3, 5, 7, 9 to 11, 13, 15, 17, 19, and 21, and 2'-OMe modifications at positions 2, 4, 6, 8, 12, 14, 16, 18, and 20 (counting from the 5' end); and
 (iv) phosphorothioate internucleotide linkages between nucleotide positions 1 and 2, and between nucleotide positions 2 and 3 (counting from the 5' end);
and
(b) an antisense strand having:
 (i) a length of 23 nucleotides;
 (ii) 2'-OMe modifications at positions 1, 3, 5, 7, 9, 11 to 13, 15, 17, 19, and 21 to 23, and 2'F modifications at positions 2, 4, 6, 8, 10, 14, 16, 18, and 20 (counting from the 5' end); and
 (iii) phosphorothioate internucleotide linkages between nucleotide positions 1 and 2, between nucleotide positions 2 and 3, between nucleotide positions 21 and 22, and between nucleotide positions 22 and 23 (counting from the 5' end);
wherein the RNAi agents have a two nucleotide overhang at the 3'-end of the antisense strand, and a blunt end at the 5'-end of the antisense strand.

In another particular embodiment, a RNAi agent of the present invention comprises:

(a) a sense strand having:
 (i) a length of 21 nucleotides;
 (ii) an ASGPR ligand attached to the 3'-end, wherein said ASGPR ligand comprises three GalNAc derivatives attached through a trivalent branched linker;
 (iii) 2'-OMe modifications at positions 1 to 6, 8, 10, and 12 to 21, 2'-F modifications at positions 7, and 9, and a deoxy-nucleotide (e.g. dT) at position 11 (counting from the 5' end); and
 (iv) phosphorothioate internucleotide linkages between nucleotide positions 1 and 2, and between nucleotide positions 2 and 3 (counting from the 5' end);

and
(b) an antisense strand having:
 (i) a length of 23 nucleotides;
 (ii) 2'-OMe modifications at positions 1, 3, 7, 9, 11, 13, 15, 17, and 19 to 23, and 2'-F modifications at positions 2, 4 to 6, 8, 10, 12, 14, 16, and 18 (counting from the 5' end); and
 (iii) phosphorothioate internucleotide linkages between nucleotide positions 1 and 2, between nucleotide positions 2 and 3, between nucleotide positions 21 and 22, and between nucleotide positions 22 and 23 (counting from the 5' end);
wherein the RNAi agents have a two nucleotide overhang at the 3'-end of the antisense strand, and a blunt end at the 5'-end of the antisense strand.

In another particular embodiment, a RNAi agent of the present invention comprises:
(a) a sense strand having:
 (i) a length of 21 nucleotides;
 (ii) an ASGPR ligand attached to the 3'-end, wherein said ASGPR ligand comprises three GalNAc derivatives attached through a trivalent branched linker;
 (iii) 2'-OMe modifications at positions 1 to 6, 8, 10, 12, 14, and 16 to 21, and 2'-F modifications at positions 7, 9, 11, 13, and 15; and
 (iv) phosphorothioate internucleotide linkages between nucleotide positions 1 and 2, and between nucleotide positions 2 and 3 (counting from the 5' end);
and
(b) an antisense strand having:
 (i) a length of 23 nucleotides;
 (ii) 2'-OMe modifications at positions 1, 5, 7, 9, 11, 13, 15, 17, 19, and 21 to 23, and 2'-F modifications at positions 2 to 4, 6, 8, 10, 12, 14, 16, 18, and 20 (counting from the 5' end); and
 (iii) phosphorothioate internucleotide linkages between nucleotide positions 1 and 2, between nucleotide positions 2 and 3, between nucleotide positions 21 and 22, and between nucleotide positions 22 and 23 (counting from the 5' end);
wherein the RNAi agents have a two nucleotide overhang at the 3'-end of the antisense strand, and a blunt end at the 5'-end of the antisense strand.

In another particular embodiment, a RNAi agent of the present invention comprises:
(a) a sense strand having:
 (i) a length of 21 nucleotides;
 (ii) an ASGPR ligand attached to the 3'-end, wherein said ASGPR ligand comprises three GalNAc derivatives attached through a trivalent branched linker;
 (iii) 2'-OMe modifications at positions 1 to 9, and 12 to 21, and 2'-F modifications at positions 10, and 11; and
 (iv) phosphorothioate internucleotide linkages between nucleotide positions 1 and 2, and between nucleotide positions 2 and 3 (counting from the 5' end);
and
(b) an antisense strand having:
 (i) a length of 23 nucleotides;
 (ii) 2'-OMe modifications at positions 1, 3, 5, 7, 9, 11 to 13, 15, 17, 19, and 21 to 23, and 2'-F modifications at positions 2, 4, 6, 8, 10, 14, 16, 18, and 20 (counting from the 5' end); and
 (iii) phosphorothioate internucleotide linkages between nucleotide positions 1 and 2, between nucleotide positions 2 and 3, between nucleotide positions 21 and 22, and between nucleotide positions 22 and 23 (counting from the 5' end);
wherein the RNAi agents have a two nucleotide overhang at the 3'-end of the antisense strand, and a blunt end at the 5'-end of the antisense strand.

In another particular embodiment, a RNAi agent of the present invention comprises:
(a) a sense strand having:
 (i) a length of 21 nucleotides;
 (ii) an ASGPR ligand attached to the 3'-end, wherein said ASGPR ligand comprises three GalNAc derivatives attached through a trivalent branched linker;
 (iii) 2'-F modifications at positions 1, 3, 5, 7, 9 to 11, and 13, and 2'-OMe modifications at positions 2, 4, 6, 8, 12, and 14 to 21; and
 (iv) phosphorothioate internucleotide linkages between nucleotide positions 1 and 2, and between nucleotide positions 2 and 3 (counting from the 5' end);
and
(b) an antisense strand having:
 (i) a length of 23 nucleotides;
 (ii) 2'-OMe modifications at positions 1, 3, 5 to 7, 9, 11 to 13, 15, 17 to 19, and 21 to 23, and 2'-F modifications at positions 2, 4, 8, 10, 14, 16, and 20 (counting from the 5' end); and
 (iii) phosphorothioate internucleotide linkages between nucleotide positions 1 and 2, between nucleotide positions 2 and 3, between nucleotide positions 21 and 22, and between nucleotide positions 22 and 23 (counting from the 5' end);
wherein the RNAi agents have a two nucleotide overhang at the 3'-end of the antisense strand, and a blunt end at the 5'-end of the antisense strand.

In another particular embodiment, a RNAi agent of the present invention comprises:
(a) a sense strand having:
 (i) a length of 21 nucleotides;
 (ii) an ASGPR ligand attached to the 3'-end, wherein said ASGPR ligand comprises three GalNAc derivatives attached through a trivalent branched linker;
 (iii) 2'-OMe modifications at positions 1, 2, 4, 6, 8, 12, 14, 15, 17, and 19 to 21, and 2'-F modifications at positions 3, 5, 7, 9 to 11, 13, 16, and 18; and
 (iv) phosphorothioate internucleotide linkages between nucleotide positions 1 and 2, and between nucleotide positions 2 and 3 (counting from the 5' end);
and
(b) an antisense strand having:
 (i) a length of 25 nucleotides;
 (ii) 2'-OMe modifications at positions 1, 4, 6, 7, 9, 11 to 13, 15, 17, and 19 to 23, 2'-F modifications at positions 2, 3, 5, 8, 10, 14, 16, and 18, and deoxynucleotides (e.g. dT) at positions 24 and 25 (counting from the 5' end); and
 (iii) phosphorothioate internucleotide linkages between nucleotide positions 1 and 2, between nucleotide positions 2 and 3, between nucleotide positions 21 and 22, and between nucleotide positions 22 and 23 (counting from the 5' end);
wherein the RNAi agents have a four nucleotide overhang at the 3'-end of the antisense strand, and a blunt end at the 5'-end of the antisense strand.

In another particular embodiment, a RNAi agent of the present invention comprises:
(a) a sense strand having:
  (i) a length of 21 nucleotides;
  (ii) an ASGPR ligand attached to the 3'-end, wherein said ASGPR ligand comprises three GalNAc derivatives attached through a trivalent branched linker;
  (iii) 2'-OMe modifications at positions 1 to 6, 8, and 12 to 21, and 2'-F modifications at positions 7, and 9 to 11; and
  (iv) phosphorothioate internucleotide linkages between nucleotide positions 1 and 2, and between nucleotide positions 2 and 3 (counting from the 5' end);
and
(b) an antisense strand having:
  (i) a length of 23 nucleotides;
  (ii) 2'-OMe modifications at positions 1, 3 to 5, 7, 8, 10 to 13, 15, and 17 to 23, and 2'-F modifications at positions 2, 6, 9, 14, and 16 (counting from the 5' end); and
  (iii) phosphorothioate internucleotide linkages between nucleotide positions 1 and 2, between nucleotide positions 2 and 3, between nucleotide positions 21 and 22, and between nucleotide positions 22 and 23 (counting from the 5' end);
wherein the RNAi agents have a two nucleotide overhang at the 3'-end of the antisense strand, and a blunt end at the 5'-end of the antisense strand.

In another particular embodiment, a RNAi agent of the present invention comprises:
(a) a sense strand having:
  (i) a length of 21 nucleotides;
  (ii) an ASGPR ligand attached to the 3'-end, wherein said ASGPR ligand comprises three GalNAc derivatives attached through a trivalent branched linker;
  (iii) 2'-OMe modifications at positions 1 to 6, 8, and 12 to 21, and 2'-F modifications at positions 7, and 9 to 11; and
  (iv) phosphorothioate internucleotide linkages between nucleotide positions 1 and 2, and between nucleotide positions 2 and 3 (counting from the 5' end);
and
(b) an antisense strand having:
  (i) a length of 23 nucleotides;
  (ii) 2'-OMe modifications at positions 1, 3 to 5, 7, 10 to 13, 15, and 17 to 23, and 2'-F modifications at positions 2, 6, 8, 9, 14, and 16 (counting from the 5' end); and
  (iii) phosphorothioate internucleotide linkages between nucleotide positions 1 and 2, between nucleotide positions 2 and 3, between nucleotide positions 21 and 22, and between nucleotide positions 22 and 23 (counting from the 5' end);
wherein the RNAi agents have a two nucleotide overhang at the 3'-end of the antisense strand, and a blunt end at the 5'-end of the antisense strand.

In another particular embodiment, a RNAi agent of the present invention comprises:
(a) a sense strand having:
  (i) a length of 19 nucleotides;
  (ii) an ASGPR ligand attached to the 3'-end, wherein said ASGPR ligand comprises three GalNAc derivatives attached through a trivalent branched linker;
  (iii) 2'-OMe modifications at positions 1 to 4, 6, and 10 to 19, and 2'-F modifications at positions 5, and 7 to 9; and
  (iv) phosphorothioate internucleotide linkages between nucleotide positions 1 and 2, and between nucleotide positions 2 and 3 (counting from the 5' end);
and
(b) an antisense strand having:
  (i) a length of 21 nucleotides;
  (ii) 2'-OMe modifications at positions 1, 3 to 5, 7, 10 to 13, 15, and 17 to 21, and 2'-F modifications at positions 2, 6, 8, 9, 14, and 16 (counting from the 5' end); and
  (iii) phosphorothioate internucleotide linkages between nucleotide positions 1 and 2, between nucleotide positions 2 and 3, between nucleotide positions 19 and 20, and between nucleotide positions 20 and 21 (counting from the 5' end);
wherein the RNAi agents have a two nucleotide overhang at the 3'-end of the antisense strand, and a blunt end at the 5'-end of the antisense strand.

In certain embodiments, the iRNA for use in the methods of the invention is an agent selected from agents listed in any one of Tables 2-3 and 7-8. These agents may further comprise a ligand.

III. iRNAs Conjugated to Ligands

Another modification of the RNA of an iRNA of the invention involves chemically linking to the iRNA one or more ligands, moieties or conjugates that enhance the activity, cellular distribution, or cellular uptake of the iRNA e.g., into a cell. Such moieties include but are not limited to lipid moieties such as a cholesterol moiety (Letsinger et al., *Proc. Natl. Acid. Sci. USA*, 1989, 86: 6553-6556). In other embodiments, the ligand is cholic acid (Manoharan et al., *Biorg. Med. Chem. Let.*, 1994, 4:1053-1060), a thioether, e.g., beryl-S-tritylthiol (Manoharan et al., *Ann. N.Y. Acad. Sci.*, 1992, 660:306-309; Manoharan et al., *Biorg. Med. Chem. Let.*, 1993, 3:2765-2770), a thiocholesterol (Oberhauser et al., *Nucl. Acids Res.*, 1992, 20:533-538), an aliphatic chain, e.g., dodecandiol or undecyl residues (Saison-Behmoaras et al., *EMBO J*, 1991, 10:1111-1118; Kabanov et al., *FEBS Lett.*, 1990, 259:327-330; Svinarchuk et al., *Biochimie*, 1993, 75:49-54), a phospholipid, e.g., di-hexadecyl-rac-glycerol or triethyl-ammonium 1,2-di-O-hexadecyl-rac-glycero-3-phosphonate (Manoharan et al., *Tetrahedron Lett.*, 1995, 36:3651-3654; Shea et al., *Nucl. Acids Res.*, 1990, 18:3777-3783), a polyamine or a polyethylene glycol chain (Manoharan et al., *Nucleosides & Nucleotides*, 1995, 14:969-973), or adamantane acetic acid (Manoharan et al., *Tetrahedron Lett.*, 1995, 36:3651-3654), a palmityl moiety (Mishra et al., *Biochim. Biophys. Acta*, 1995, 1264:229-237), or an octadecylamine or hexylaminocarbonyloxycholesterol moiety (Crooke et al., *J. Pharmacol. Exp. Ther.*, 1996, 277:923-937).

In certain embodiments, a ligand alters the distribution, targeting, or lifetime of an iRNA agent into which it is incorporated. In some embodiments a ligand provides an enhanced affinity for a selected target, e.g., molecule, cell or cell type, compartment, e.g., a cellular or organ compartment, tissue, organ or region of the body, as, e.g., compared to a species absent such a ligand. In some embodiments, ligands do not take part in duplex pairing in a duplexed nucleic acid.

Ligands can include a naturally occurring substance, such as a protein (e.g., human serum albumin (HSA), low-density lipoprotein (LDL), or globulin); carbohydrate (e.g., a dextran, pullulan, chitin, chitosan, inulin, cyclodextrin, N-acetylglucosamine, N-acetylgalactosamine, or hyaluronic acid); or a lipid. The ligand can also be a recombinant or synthetic molecule, such as a synthetic polymer, e.g., a synthetic polyamino acid. Examples of polyamino acids include polyamino acid is a polylysine (PLL), poly L-aspartic acid, poly L-glutamic acid, styrene-maleic acid anhydride copolymer, poly(L-lactide-co-glycolied) copolymer, divinyl ether-maleic anhydride copolymer, N-(2-hydroxypropyl)methacrylamide copolymer (HMPA), polyethylene glycol (PEG), polyvinyl alcohol (PVA), polyurethane, poly (2-ethylacryllic acid), N-isopropylacrylamide polymers, or polyphosphazine. Example of polyamines include: polyethylenimine, polylysine (PLL), spermine, spermidine, polyamine, pseudopeptide-polyamine, peptidomimetic polyamine, dendrimer polyamine, arginine, amidine, protamine, cationic lipid, cationic porphyrin, quaternary salt of a polyamine, or an alpha helical peptide.

Ligands can also include targeting groups, e.g., a cell or tissue targeting agent, e.g., a lectin, glycoprotein, lipid or protein, e.g., an antibody, that binds to a specified cell type such as a kidney cell. A targeting group can be a thyrotropin, melanotropin, lectin, glycoprotein, surfactant protein A, Mucin carbohydrate, multivalent lactose, multivalent galactose, N-acetyl-galactosamine, N-acetyl-glucosamine multivalent mannose, multivalent fucose, glycosylated polyaminoacids, multivalent galactose, transferrin, bisphosphonate, polyglutamate, polyaspartate, a lipid, cholesterol, a steroid, bile acid, folate, vitamin B12, vitamin A, biotin, or an RGD peptide or RGD peptide mimetic. In certain embodiments, the ligand is a multivalent galactose, e.g., an N-acetyl-galactosamine Other examples of ligands include dyes, intercalating agents (e.g. acridines), cross-linkers (e.g. psoralene, mitomycin C), porphyrins (TPPC4, texaphyrin, Sapphyrin), polycyclic aromatic hydrocarbons (e.g., phenazine, dihydrophenazine), artificial endonucleases (e.g. EDTA), lipophilic molecules, e.g., cholesterol, cholic acid, adamantane acetic acid, 1-pyrene butyric acid, dihydrotestosterone, 1,3-Bis-O(hexadecyl)glycerol, geranyloxyhexyl group, hexadecylglycerol, borneol, menthol, 1,3-propanediol, heptadecyl group, palmitic acid, myristic acid, O3-(oleoyl) lithocholic acid, 03-(oleoyl)cholenic acid, dimethoxytrityl, or phenoxazine) and peptide conjugates (e.g., antennapedia peptide, Tat peptide), alkylating agents, phosphate, amino, mercapto, PEG (e.g., PEG-40K), MPEG, [MPEG]2, polyamino, alkyl, substituted alkyl, radiolabeled markers, enzymes, haptens (e.g. biotin), transport/absorption facilitators (e.g., aspirin, vitamin E, folic acid), synthetic ribonucleases (e.g., imidazole, bisimidazole, histamine, imidazole clusters, acridine-imidazole conjugates, Eu3+ complexes of tetraazamacrocycles), dinitrophenyl, HRP, or AP.

Ligands can be proteins, e.g., glycoproteins, or peptides, e.g., molecules having a specific affinity for a co-ligand, or antibodies e.g., an antibody, that binds to a specified cell type such as a hepatic cell. Ligands can also include hormones and hormone receptors. They can also include non-peptidic species, such as lipids, lectins, carbohydrates, vitamins, cofactors, multivalent lactose, multivalent galactose, N-acetyl-galactosamine, N-acetyl-glucosamine multivalent mannose, or multivalent fucose. The ligand can be, for example, a lipopolysaccharide, an activator of p38 MAP kinase, or an activator of NF-κB.

The ligand can be a substance, e.g., a drug, which can increase the uptake of the iRNA agent into the cell, for example, by disrupting the cell's cytoskeleton, e.g., by disrupting the cell's microtubules, microfilaments, or intermediate filaments. The drug can be, for example, taxol, vincristine, vinblastine, cytochalasin, nocodazole, japlakinolide, latrunculin A, phalloidin, swinholide A, indanocine, or myoservin.

In some embodiments, a ligand attached to an iRNA as described herein acts as a pharmacokinetic modulator (PK modulator). PK modulators include lipophiles, bile acids, steroids, phospholipid analogues, peptides, protein binding agents, PEG, vitamins, etc. Exemplary PK modulators include, but are not limited to, cholesterol, fatty acids, cholic acid, lithocholic acid, dialkylglycerides, diacylglyceride, phospholipids, sphingolipids, naproxen, ibuprofen, vitamin E, biotin. Oligonucleotides that comprise a number of phosphorothioate linkages are also known to bind to serum protein, thus short oligonucleotides, e.g., oligonucleotides of about 5 bases, 10 bases, 15 bases, or 20 bases, comprising multiple of phosphorothioate linkages in the backbone are also amenable to the present invention as ligands (e.g. as PK modulating ligands). In addition, aptamers that bind serum components (e.g. serum proteins) are also suitable for use as PK modulating ligands in the embodiments described herein.

Ligand-conjugated iRNAs of the invention may be synthesized by the use of an oligonucleotide that bears a pendant reactive functionality, such as that derived from the attachment of a linking molecule onto the oligonucleotide (described below). This reactive oligonucleotide may be reacted directly with commercially-available ligands, ligands that are synthesized bearing any of a variety of protecting groups, or ligands that have a linking moiety attached thereto.

The oligonucleotides used in the conjugates of the present invention may be conveniently and routinely made through the well-known technique of solid-phase synthesis. Equipment for such synthesis is sold by several vendors including, for example, Applied Biosystems® (Foster City, Calif.). Any other methods for such synthesis known in the art may additionally or alternatively be employed. It is also known to use similar techniques to prepare other oligonucleotides, such as the phosphorothioates and alkylated derivatives.

In the ligand-conjugated iRNAs and ligand-molecule bearing sequence-specific linked nucleosides of the present invention, the oligonucleotides and oligonucleosides may be assembled on a suitable DNA synthesizer utilizing standard nucleotide or nucleoside precursors, or nucleotide or nucleoside conjugate precursors that already bear the linking moiety, ligand-nucleotide or nucleoside-conjugate precursors that already bear the ligand molecule, or non-nucleoside ligand-bearing building blocks.

When using nucleotide-conjugate precursors that already bear a linking moiety, the synthesis of the sequence-specific linked nucleosides is typically completed, and the ligand molecule is then reacted with the linking moiety to form the ligand-conjugated oligonucleotide. In some embodiments, the oligonucleotides or linked nucleosides of the present invention are synthesized by an automated synthesizer using phosphoramidites derived from ligand-nucleoside conjugates in addition to the standard phosphoramidites and non-standard phosphoramidites that are commercially available and routinely used in oligonucleotide synthesis.

A. Lipid Conjugates

In certain embodiments, the ligand or conjugate is a lipid or lipid-based molecule. In one embodiment, such a lipid or lipid-based molecule binds a serum protein, e.g., human serum albumin (HSA). An HSA binding ligand allows for distribution of the conjugate to a target tissue, e.g., a non-kidney target tissue of the body. For example, the target tissue can be the liver, including parenchymal cells of the liver. Other molecules that can bind HSA can also be used as ligands. For example, naproxen or aspirin can be used. A lipid or lipid-based ligand can (a) increase resistance to degradation of the conjugate, (b) increase targeting or transport into a target cell or cell membrane, or (c) can be used to adjust binding to a serum protein, e.g., HSA.

A lipid based ligand can be used to inhibit, e.g., control the binding of the conjugate to a target tissue. For example, a lipid or lipid-based ligand that binds to HSA more strongly will be less likely to be targeted to the kidney and therefore less likely to be cleared from the body. A lipid or lipid-based ligand that binds to HSA less strongly can be used to target the conjugate to the kidney.

In certain embodiments, the lipid based ligand binds HSA. In one embodiment, it binds HSA with a sufficient affinity such that the conjugate will be distributed to a non-kidney tissue. However, it is preferred that the affinity not be so strong that the HSA-ligand binding cannot be reversed.

In other embodiments, the lipid based ligand binds HSA weakly or not at all. In one embodiment, the conjugate will be distributed to the kidney. Other moieties that target to kidney cells can also be used in place of, or in addition to, the lipid based ligand.

In another aspect, the ligand is a moiety, e.g., a vitamin, which is taken up by a target cell, e.g., a proliferating cell. These are particularly useful for treating disorders characterized by unwanted cell proliferation, e.g., of the malignant or non-malignant type, e.g., cancer cells. Exemplary vitamins include vitamin A, E, and K. Other exemplary vitamins include are B vitamin, e.g., folic acid, B12, riboflavin, biotin, pyridoxal or other vitamins or nutrients taken up by target cells such as liver cells. Also included are HSA and low density lipoprotein (LDL).

B. Cell Permeation Agents

In another aspect, the ligand is a cell-permeation agent, such as, a helical cell-permeation agent. In one embodiment, the agent is amphipathic. An exemplary agent is a peptide such as tat or antennopedia. If the agent is a peptide, it can be modified, including a peptidylmimetic, invertomers, non-peptide or pseudo-peptide linkages, and use of D-amino acids. In one embodiment, the helical agent is an alpha-helical agent, which has a lipophilic and a lipophobic phase.

The ligand can be a peptide or peptidomimetic. A peptidomimetic (also referred to herein as an oligopeptidomimetic) is a molecule capable of folding into a defined three-dimensional structure similar to a natural peptide. The attachment of peptide and peptidomimetics to iRNA agents can affect pharmacokinetic distribution of the iRNA, such as by enhancing cellular recognition and absorption. The peptide or peptidomimetic moiety can be about 5-50 amino acids long, e.g., about 5, 10, 15, 20, 25, 30, 35, 40, 45, or 50 amino acids long.

A peptide or peptidomimetic can be, for example, a cell permeation peptide, cationic peptide, amphipathic peptide, or hydrophobic peptide (e.g., consisting primarily of Tyr, Trp, or Phe). The peptide moiety can be a dendrimer peptide, constrained peptide or crosslinked peptide. In another alternative, the peptide moiety can include a hydrophobic membrane translocation sequence (MTS). An exemplary hydrophobic MTS-containing peptide is RFGF having the amino acid sequence AAVALLPAVLLALLAP (SEQ ID NO: 14). An RFGF analogue (e.g., amino acid sequence AALLPVL-LAAP (SEQ ID NO:15) containing a hydrophobic MTS can also be a targeting moiety.

The peptide moiety can be a "delivery" peptide, which can carry large polar molecules including peptides, oligo-nucleotides, and protein across cell membranes. For example, sequences from the HIV Tat protein (GRKKRRQRRRPPQ (SEQ ID NO:16) and the *Drosophila* Antennapedia protein (RQIKIWFQNRRMKWKK (SEQ ID NO:17) have been found to be capable of functioning as delivery peptides. A peptide or peptidomimetic can be encoded by a random sequence of DNA, such as a peptide identified from a phage-display library, or one-bead-one-compound (OBOC) combinatorial library (Lam et al., Nature, 354:82-84, 1991). Examples of a peptide or peptidomimetic tethered to a dsRNA agent via an incorporated monomer unit for cell targeting purposes is an arginine-glycine-aspartic acid (RGD)-peptide, or RGD mimic. A peptide moiety can range in length from about 5 amino acids to about 40 amino acids. The peptide moieties can have a structural modification, such as to increase stability or direct conformational properties. Any of the structural modifications described below can be utilized.

An RGD peptide for use in the compositions and methods of the invention may be linear or cyclic, and may be modified, e.g., glycosylated or methylated, to facilitate targeting to a specific tissue(s). RGD-containing peptides and peptidiomimemtics may include D-amino acids, as well as synthetic RGD mimics. In addition to RGD, one can use other moieties that target the integrin ligand, e.g., PECAM-1 or VEGF.

A "cell permeation peptide" is capable of permeating a cell, e.g., a microbial cell, such as a bacterial or fungal cell, or a mammalian cell, such as a human cell. A microbial cell-permeating peptide can be, for example, an α-helical linear peptide (e.g., LL-37 or Ceropin P1), a disulfide bond-containing peptide (e.g., α-defensin, β-defensin or bactenecin), or a peptide containing only one or two dominating amino acids (e.g., PR-39 or indolicidin). A cell permeation peptide can also include a nuclear localization signal (NLS). For example, a cell permeation peptide can be a bipartite amphipathic peptide, such as MPG, which is derived from the fusion peptide domain of HIV-1 gp41 and the NLS of SV40 large T antigen (Simeoni et al., Nucl. Acids Res. 31:2717-2724, 2003).

C. Carbohydrate Conjugates

In some embodiments of the compositions and methods of the invention, an iRNA further comprises a carbohydrate. The carbohydrate conjugated iRNA is advantageous for the in vivo delivery of nucleic acids, as well as compositions suitable for in vivo therapeutic use, as described herein. As used herein, "carbohydrate" refers to a compound which is either a carbohydrate per se made up of one or more monosaccharide units having at least 6 carbon atoms (which can be linear, branched or cyclic) with an oxygen, nitrogen or sulfur atom bonded to each carbon atom; or a compound having as a part thereof a carbohydrate moiety made up of one or more monosaccharide units each having at least six carbon atoms (which can be linear, branched or cyclic), with an oxygen, nitrogen or sulfur atom bonded to each carbon atom. Representative carbohydrates include the sugars (mono-, di-, tri-, and oligosaccharides containing from about 4, 5, 6, 7, 8, or 9 monosaccharide units), and polysaccharides such as starches, glycogen, cellulose and polysaccharide gums. Specific monosaccharides include C5 and above (e.g., C5, C6, C7, or C8) sugars; di- and trisaccharides include sugars having two or three monosaccharide units (e.g., C5, C6, C7, or C8).

In certain embodiments, a carbohydrate conjugate for use in the compositions and methods of the invention is a monosaccharide.

In certain embodiments, the monosaccharide is an N-acetylgalactosamine (GalNAc). GalNAc conjugates, which comprise one or more N-acetylgalactosamine (GalNAc) derivatives, are described, for example, in U.S. Pat. No. 8,106,022, the entire content of which is hereby incorporated herein by reference. In some embodiments, the GalNAc conjugate serves as a ligand that targets the iRNA to particular cells. In some embodiments, the GalNAc conjugate targets the iRNA to liver cells, e.g., by serving as a ligand for the asialoglycoprotein receptor of liver cells (e.g., hepatocytes).

In some embodiments, the carbohydrate conjugate comprises one or more GalNAc derivatives. The GalNAc derivatives may be attached via a linker, e.g., a bivalent or trivalent branched linker. In some embodiments the GalNAc conjugate is conjugated to the 3' end of the sense strand. In some embodiments, the GalNAc conjugate is conjugated to the iRNA agent (e.g., to the 3' end of the sense strand) via a linker, e.g., a linker as described herein. In some embodiments the GalNAc conjugate is conjugated to the 5' end of the sense strand. In some embodiments, the GalNAc conjugate is conjugated to the iRNA agent (e.g., to the 5' end of the sense strand) via a linker, e.g., a linker as described herein.

In certain embodiments of the invention, the GalNAc or GalNAc derivative is attached to an iRNA agent of the invention via a monovalent linker. In some embodiments, the GalNAc or GalNAc derivative is attached to an iRNA agent of the invention via a bivalent linker. In yet other embodiments of the invention, the GalNAc or GalNAc derivative is attached to an iRNA agent of the invention via a trivalent linker. In other embodiments of the invention, the GalNAc or GalNAc derivative is attached to an iRNA agent of the invention via a tetravalent linker.

In certain embodiments, the double stranded RNAi agents of the invention comprise one GalNAc or GalNAc derivative attached to the iRNA agent. In certain embodiments, the double stranded RNAi agents of the invention comprise a plurality (e.g., 2, 3, 4, 5, or 6) GalNAc or GalNAc derivatives, each independently attached to a plurality of nucleotides of the double stranded RNAi agent through a plurality of monovalent linkers.

In some embodiments, for example, when the two strands of an iRNA agent of the invention are part of one larger molecule connected by an uninterrupted chain of nucleotides between the 3'-end of one strand and the 5'-end of the respective other strand forming a hairpin loop comprising, a plurality of unpaired nucleotides, each unpaired nucleotide within the hairpin loop may independently comprise a GalNAc or GalNAc derivative attached via a monovalent linker. The hairpin loop may also be formed by an extended overhang in one strand of the duplex.

In some embodiments, for example, when the two strands of an iRNA agent of the invention are part of one larger molecule connected by an uninterrupted chain of nucleotides between the 3'-end of one strand and the 5'-end of the respective other strand forming a hairpin loop comprising, a plurality of unpaired nucleotides, each unpaired nucleotide within the hairpin loop may independently comprise a GalNAc or GalNAc derivative attached via a monovalent linker. The hairpin loop may also be formed by an extended overhang in one strand of the duplex.

In one embodiment, a carbohydrate conjugate for use in the compositions and methods of the invention is selected from the group consisting of:

Formula II

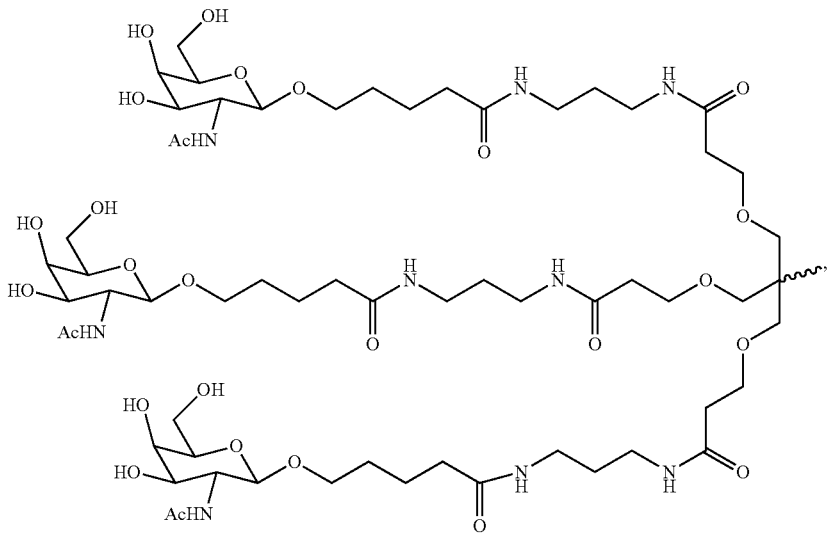

Formula III
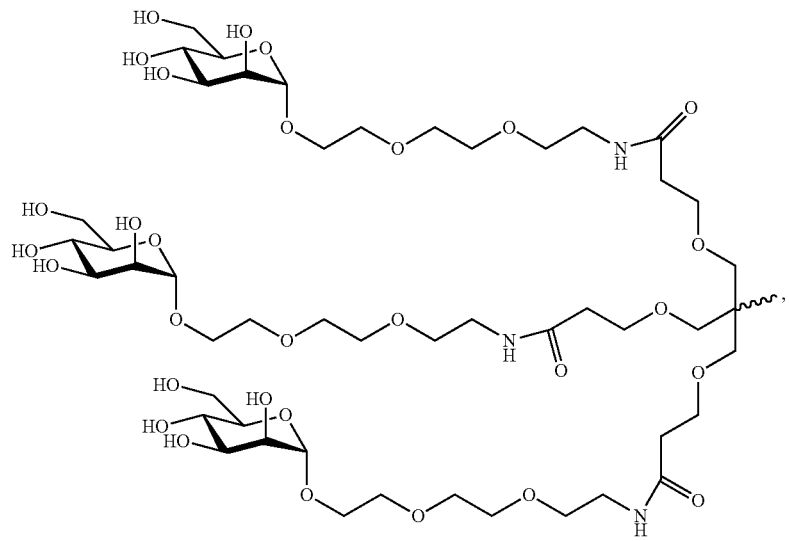
Formula IV
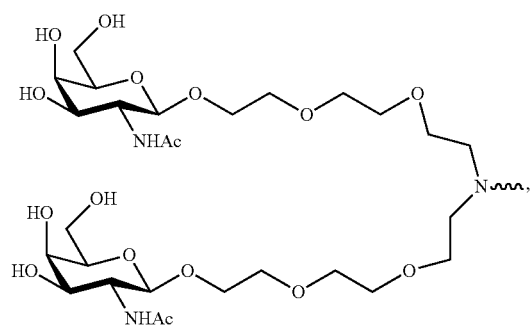
Formula V
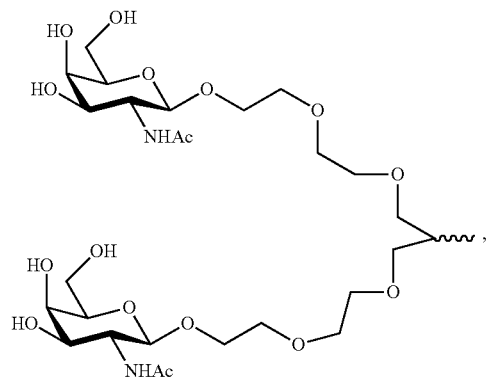
Formula VI
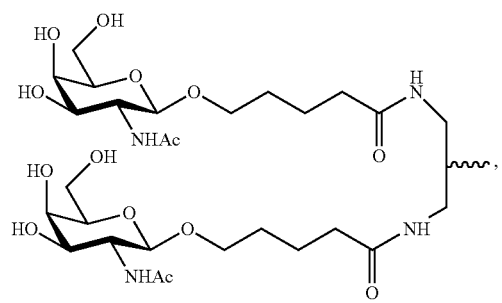

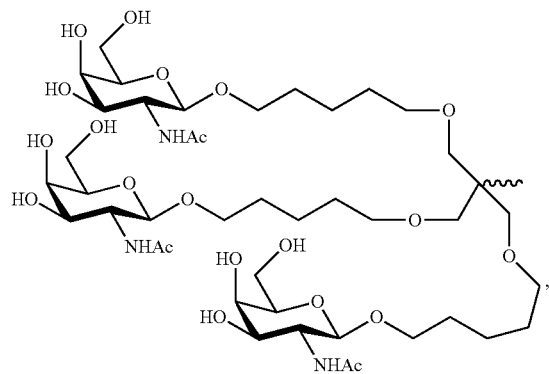
Formula VII
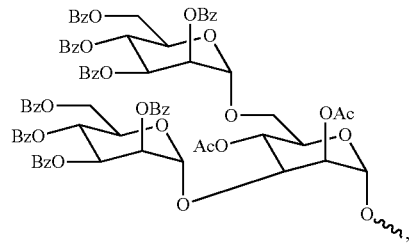
Formula VIII
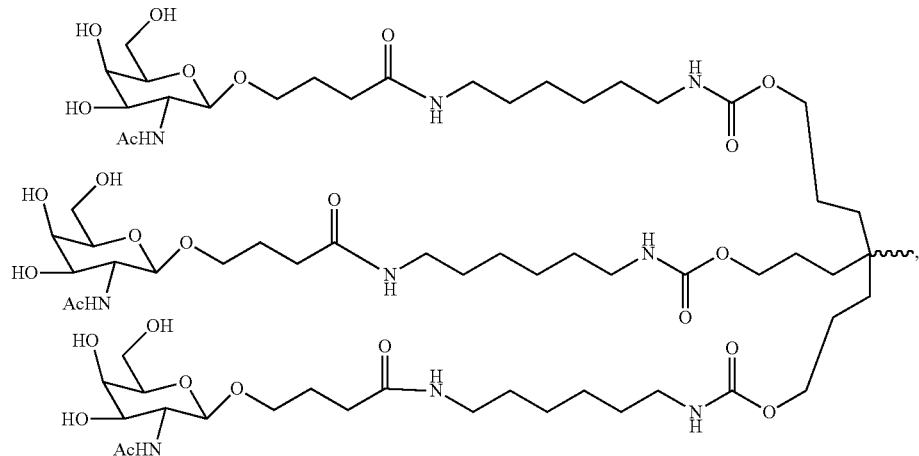
Formula IX
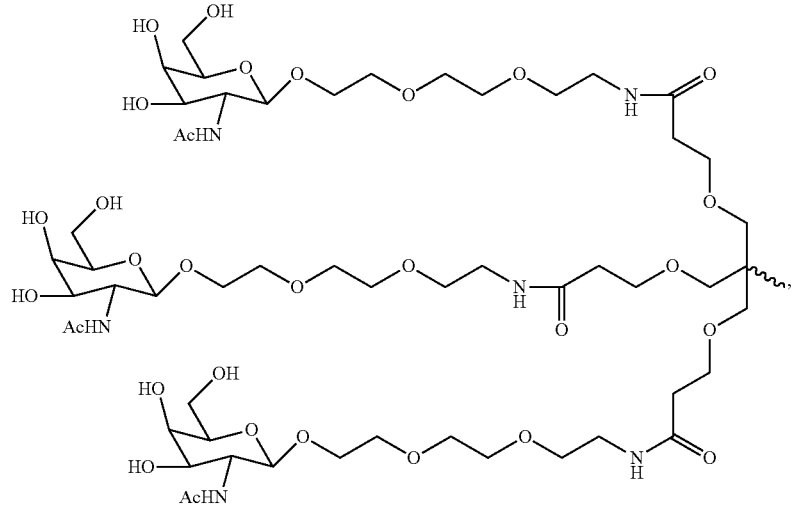
Formula X Formula XI
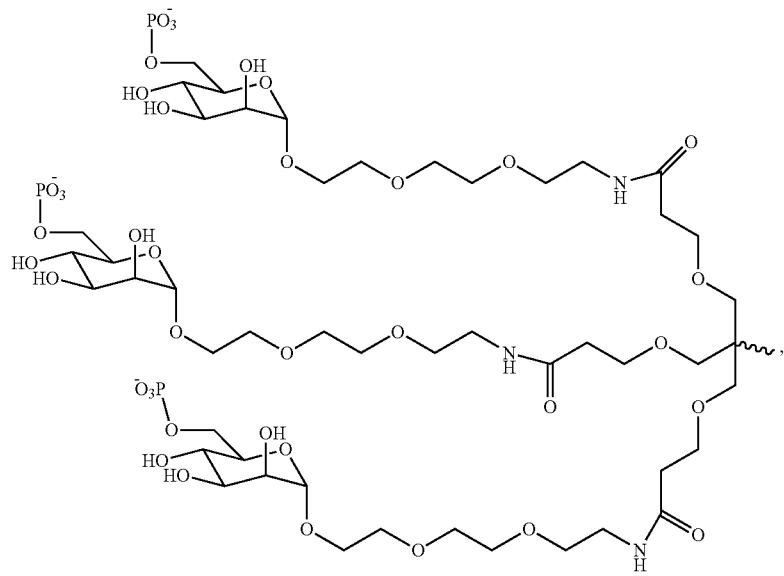
Formula XII
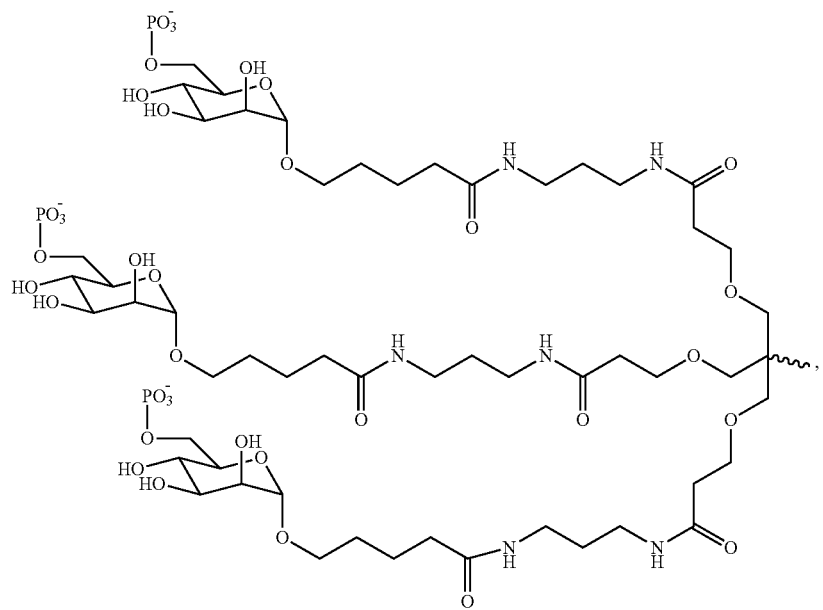
Formula XIII
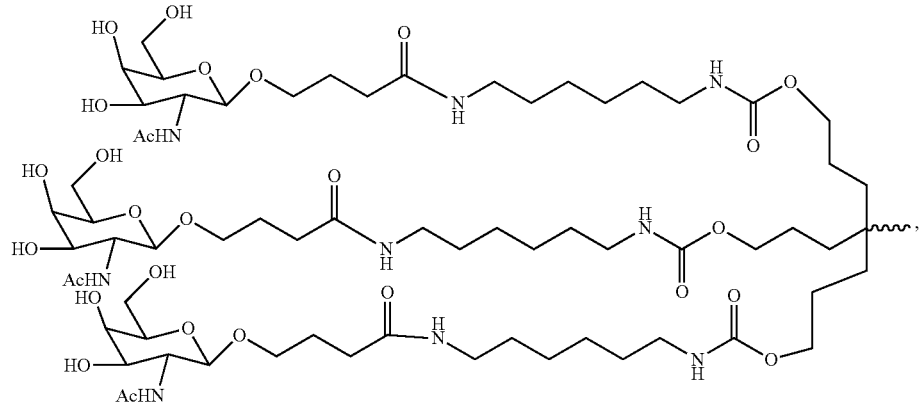

Formula XIV
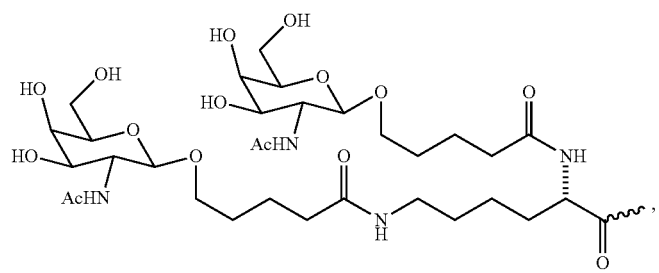
Formula XV
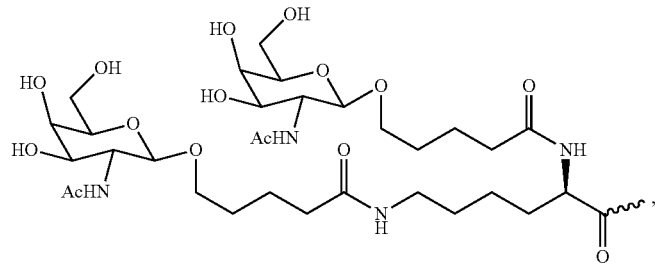
Formula XVI
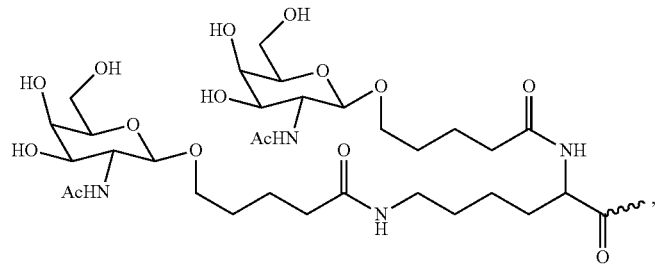
Formula XVII
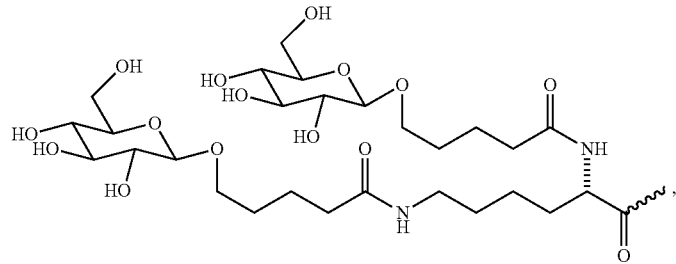
Formula XVIII
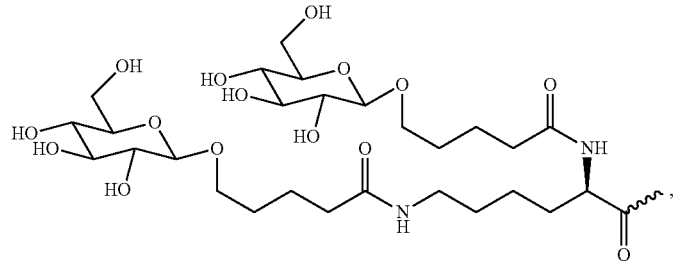
Formula XIX
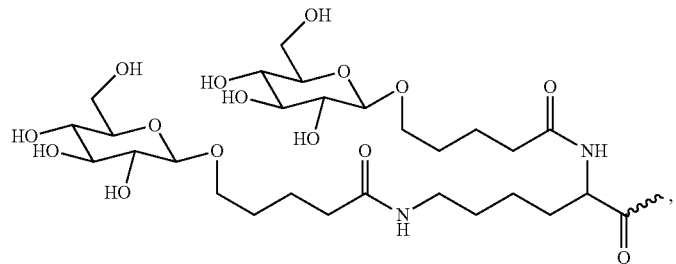

Formula XX
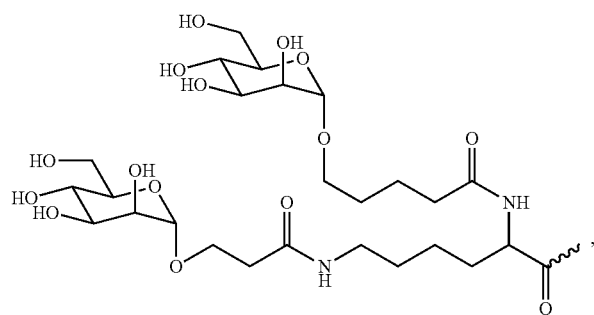
Formula XXI
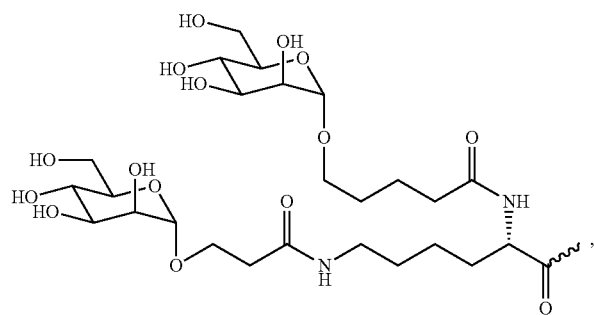
Formula XXII
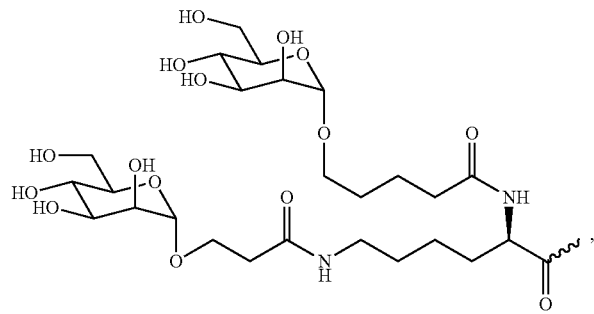
Formula XXIII
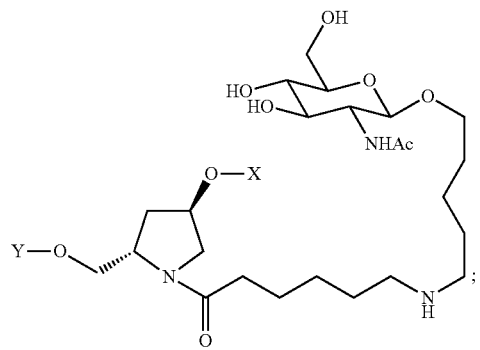

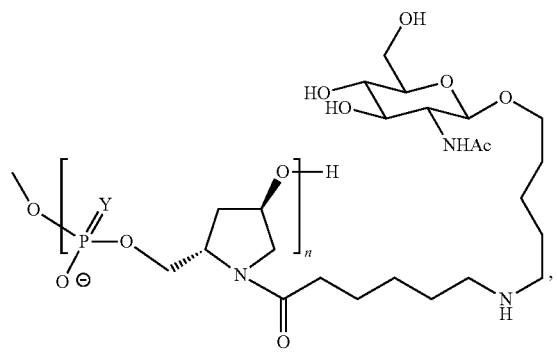
wherein Y is O or S and n is 3-6 (Formula XXIV);
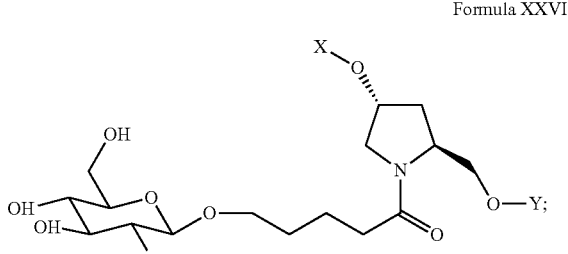
Formula XXVI
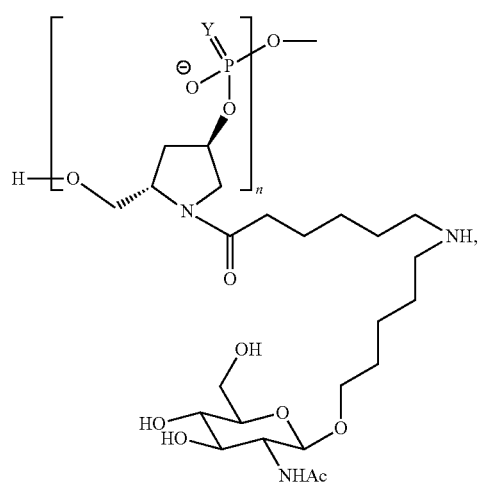
wherein Y is O or S and n is 3-6 (Formula XXV);
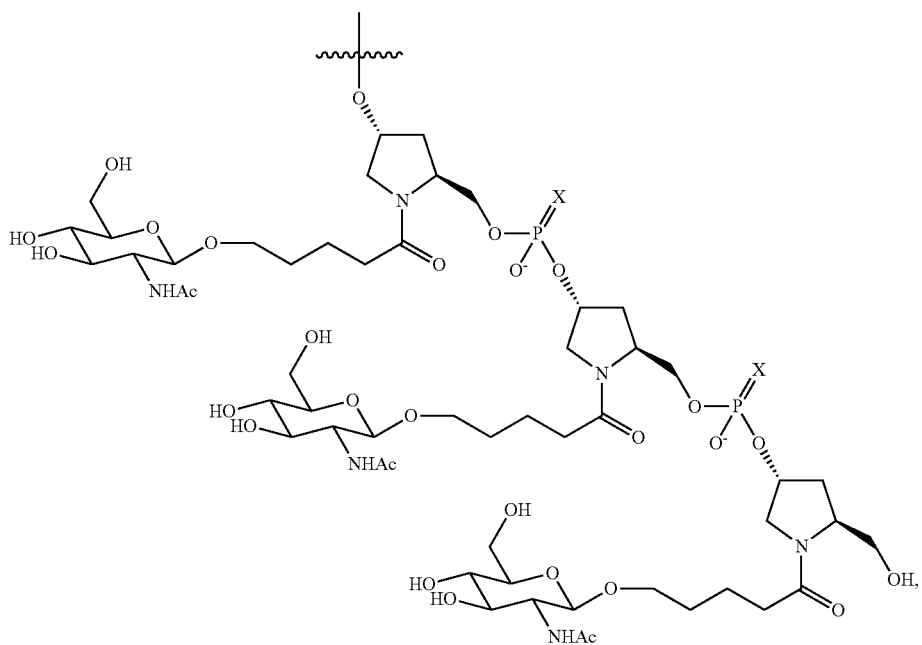
wherein X is O or S (Formula XXVII);

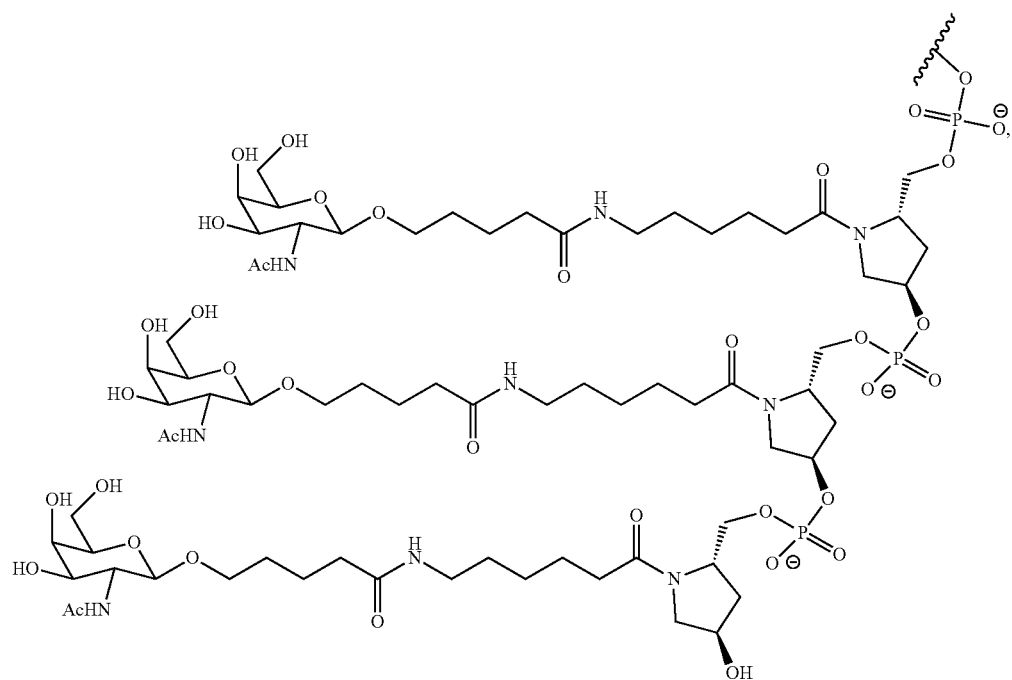
Formula XXVII
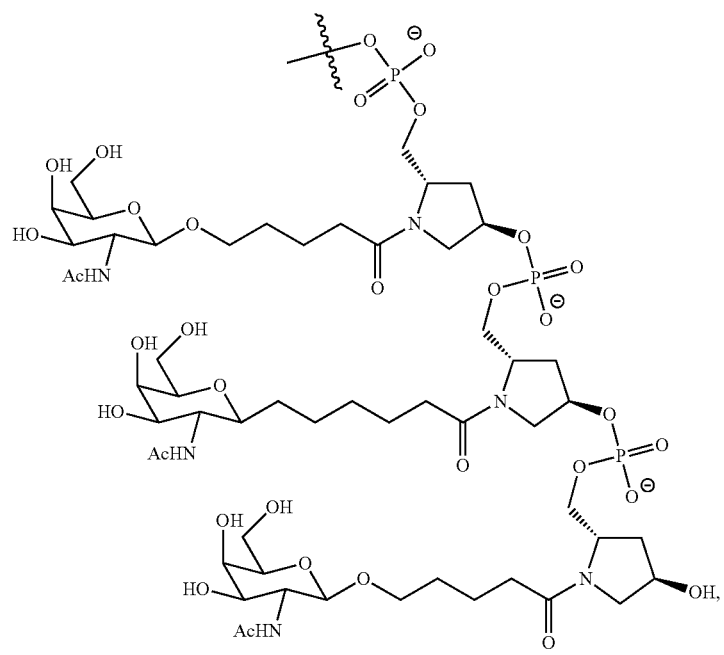
Formula XXIX

-continued
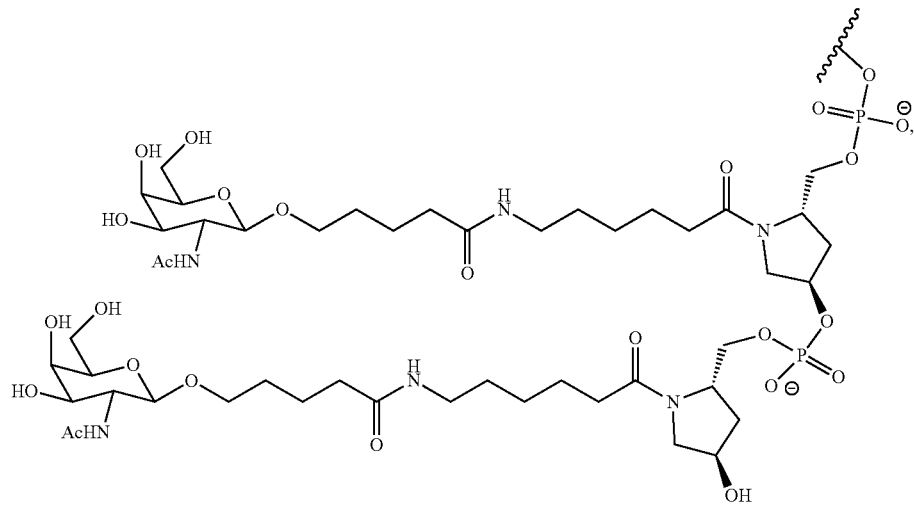
Formula XXXI
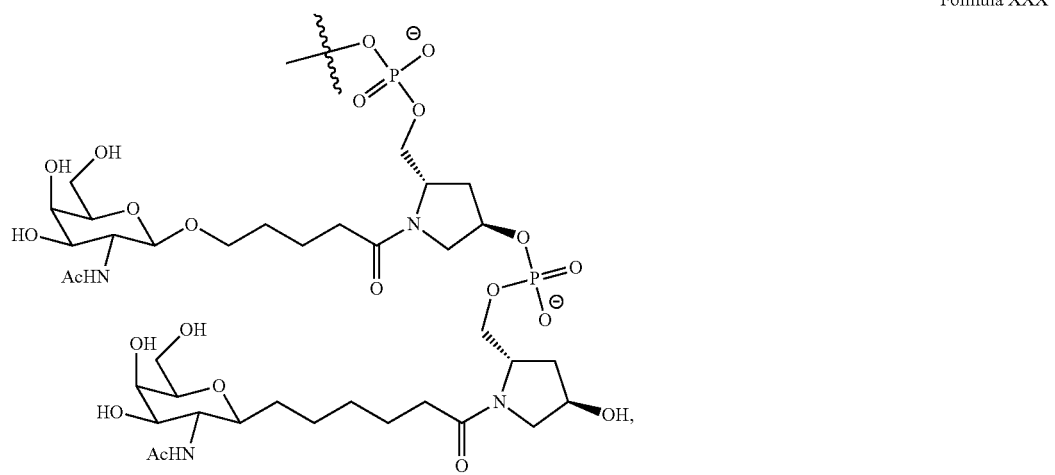
Formula XXX
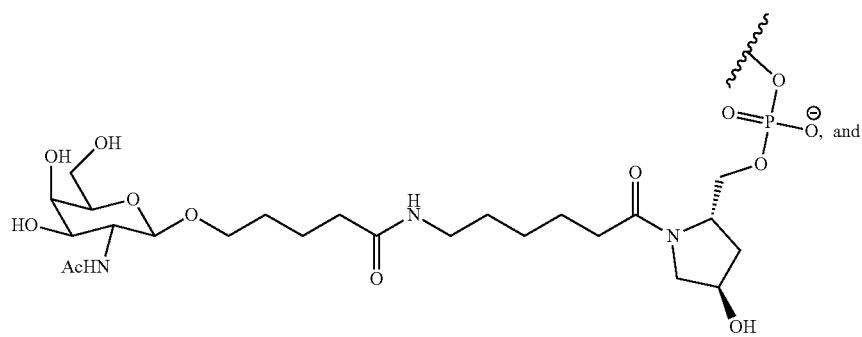
Formula XXXIII
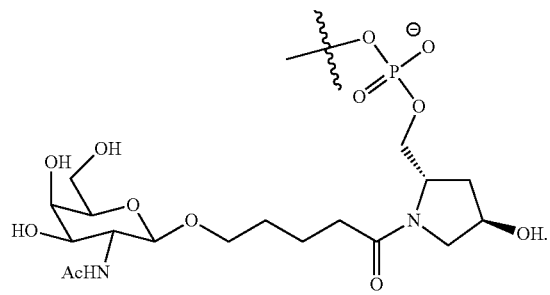
Formula XXXII Formula XXXIV

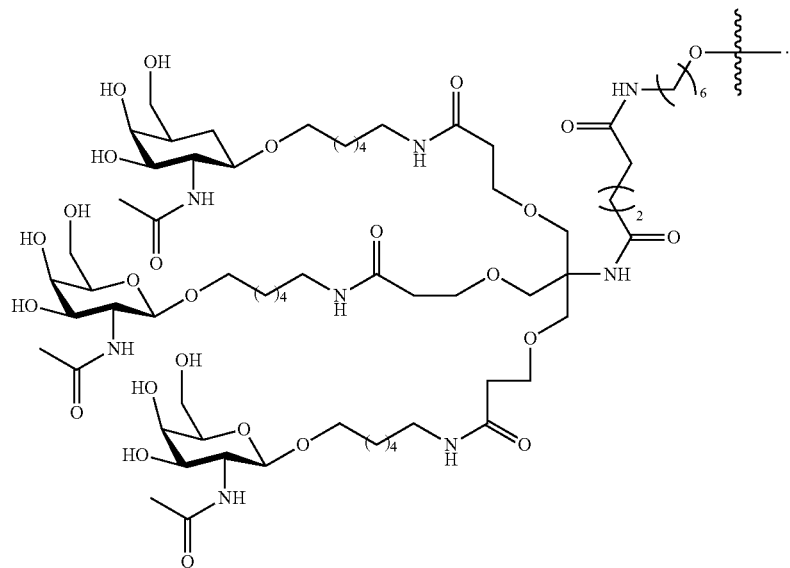

In another embodiment, a carbohydrate conjugate for use in the compositions and methods of the invention is a monosaccharide. In one embodiment, the monosaccharide is an N-acetylgalactosamine, such as Formula II

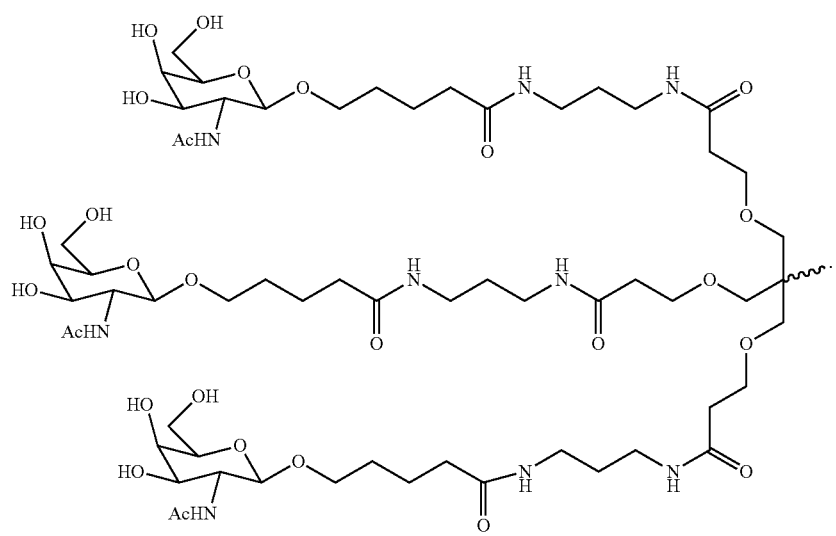

In some embodiments, the RNAi agent is attached to the carbohydrate conjugate via a linker as shown in the following schematic, wherein X is O or S

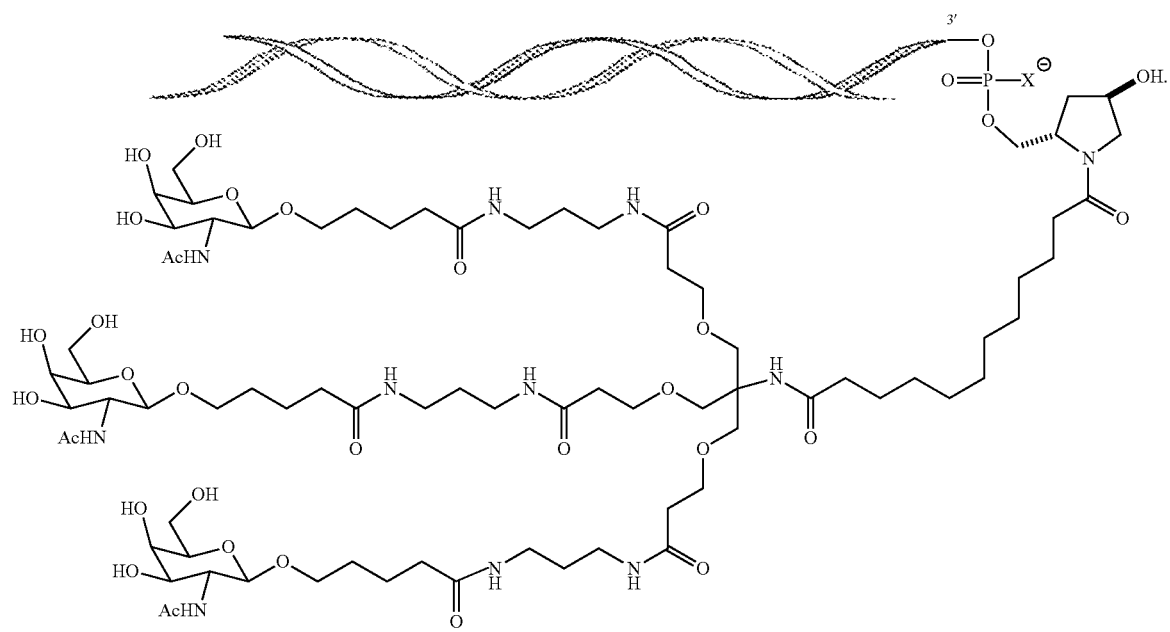
In some embodiments, the RNAi agent is conjugated to L96 as defined in Table 1 and shown below:
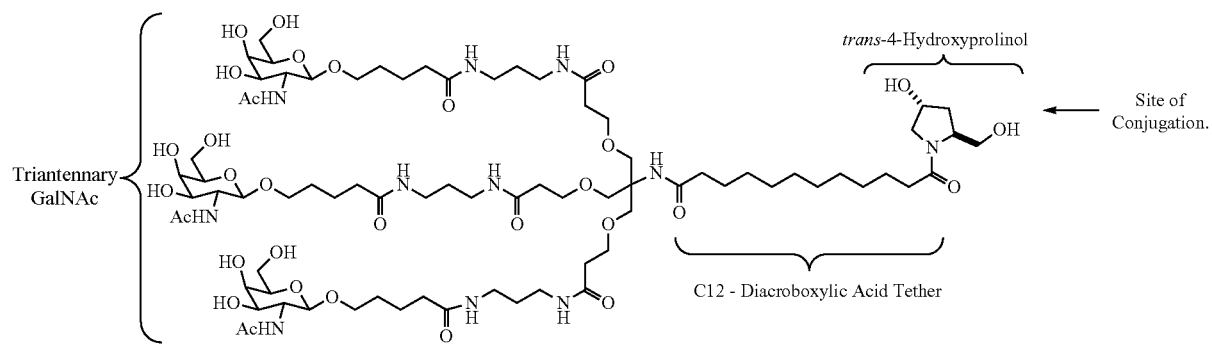
Another representative carbohydrate conjugate for use in the embodiments described herein includes, but is not limited to,

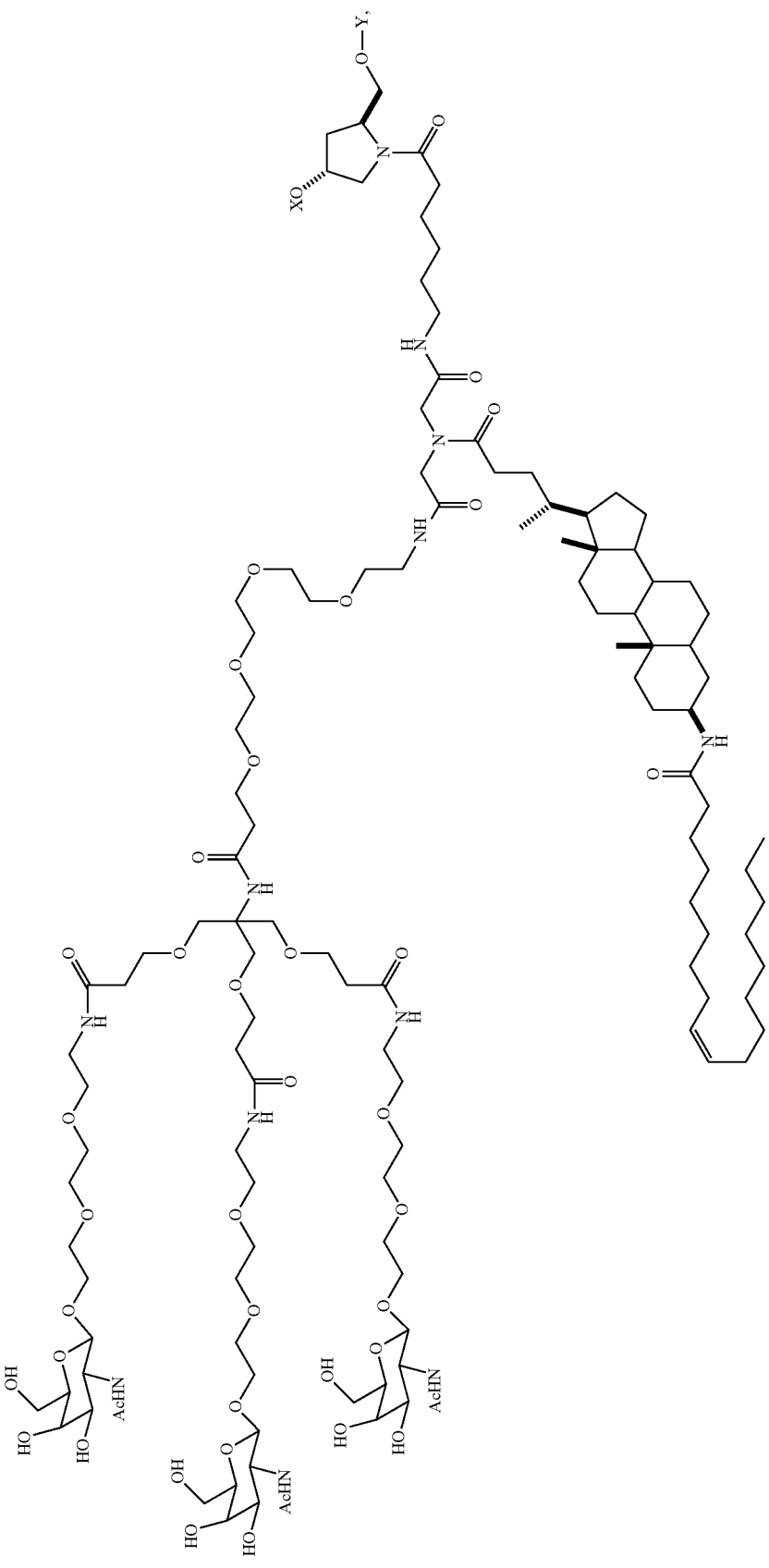
(Formula XXXVI)

when one of X or Y is an oligonucleotide, the other is a hydrogen.

In some embodiments, a suitable ligand is a ligand disclosed in WO 2019/055633, the entire contents of which are incorporated herein by reference. In one embodiment the ligand comprises the structure below:

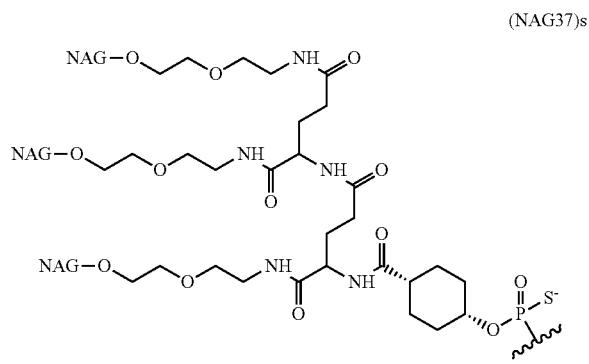

(NAG37)s

In certain embodiments of the invention, the GalNAc or GalNAc derivative is attached to an iRNA agent of the invention via a monovalent linker. In some embodiments, the GalNAc or GalNAc derivative is attached to an iRNA agent of the invention via a bivalent linker. In yet other embodiments of the invention, the GalNAc or GalNAc derivative is attached to an iRNA agent of the invention via a trivalent linker.

In one embodiment, the double stranded RNAi agents of the invention comprise one or more GalNAc or GalNAc derivative attached to the iRNA agent. The GalNAc may be attached to any nucleotide via a linker on the sense strand or antsisense strand. The GalNac may be attached to the 5'-end of the sense strand, the 3' end of the sense strand, the 5'-end of the antisense strand, or the 3'-end of the antisense strand. In one embodiment, the GalNAc is attached to the 3' end of the sense strand, e.g., via a trivalent linker.

In other embodiments, the double stranded RNAi agents of the invention comprise a plurality (e.g., 2, 3, 4, 5, or 6) GalNAc or GalNAc derivatives, each independently attached to a plurality of nucleotides of the double stranded RNAi agent through a plurality of linkers, e.g., monovalent linkers.

In some embodiments, for example, when the two strands of an iRNA agent of the invention is part of one larger molecule connected by an uninterrupted chain of nucleotides between the 3'-end of one strand and the 5'-end of the respective other strand forming a hairpin loop comprising, a plurality of unpaired nucleotides, each unpaired nucleotide within the hairpin loop may independently comprise a GalNAc or GalNAc derivative attached via a monovalent linker.

In some embodiments, the carbohydrate conjugate further comprises one or more additional ligands as described above, such as, but not limited to, a PK modulator or a cell permeation peptide.

Additional carbohydrate conjugates and linkers suitable for use in the present invention include those described in PCT Publication Nos. WO 2014/179620 and WO 2014/179627, the entire contents of each of which are incorporated herein by reference.

D. Linkers

In some embodiments, the conjugate or ligand described herein can be attached to an iRNA oligonucleotide with various linkers that can be cleavable or non-cleavable.

The term "linker" or "linking group" means an organic moiety that connects two parts of a compound, e.g., covalently attaches two parts of a compound. Linkers typically comprise a direct bond or an atom such as oxygen or sulfur, a unit such as NRB, C(O), C(O)NH, SO, $SO_2$, $SO_2$NH or a chain of atoms, such as, but not limited to, substituted or unsubstituted alkyl, substituted or unsubstituted alkenyl, substituted or unsubstituted alkynyl, arylalkyl, arylalkenyl, arylalkynyl, heteroarylalkyl, heteroarylalkenyl, heteroarylalkynyl, heterocyclylalkyl, heterocyclylalkenyl, heterocyclylalkynyl, aryl, heteroaryl, heterocyclyl, cycloalkyl, cycloalkenyl, alkylarylalkyl, alkylarylalkenyl, alkylarylalkynyl, alkenylarylalkyl, alkenylarylalkenyl, alkenylarylalkynyl, alkynylarylalkyl, alkynylarylalkenyl, alkynylarylalkynyl, alkylheteroarylalkyl, alkylheteroarylalkenyl, alkylheteroarylalkynyl, alkenylheteroarylalkyl, alkenylheteroarylalkenyl, alkenylheteroarylalkynyl, alkynylheteroarylalkyl, alkynylheteroarylalkenyl, alkynylheteroarylalkynyl, alkylheterocyclylalkyl, alkylheterocyclylalkenyl, alkylhererocyclylalkynyl, alkenylheterocyclylalkyl, alkenylheterocyclylalkenyl, alkenylheterocyclylalkynyl, alkynylheterocyclylalkyl, alkynylheterocyclylalkenyl, alkynylheterocyclylalkynyl, alkylaryl, alkenylaryl, alkynylaryl, alkylheteroaryl, alkenylheteroaryl, alkynylhereroaryl, which one or more methylenes can be interrupted or terminated by O, S, S(O), $SO_2$, N(R8), C(O), substituted or unsubstituted aryl, substituted or unsubstituted heteroaryl, or substituted or unsubstituted heterocyclic; where R8 is hydrogen, acyl, aliphatic, or substituted aliphatic. In one embodiment, the linker is about 1-24 atoms, 2-24, 3-24, 4-24, 5-24, 6-24, 6-18, 7-18, 8-18, 7-17, 8-17, 6-16, 7-17, or 8-16 atoms.

A cleavable linking group is one which is sufficiently stable outside the cell, but which upon entry into a target cell is cleaved to release the two parts the linker is holding together. In an exemplary embodiment, the cleavable linking group is cleaved at least about 10 times, 20, times, 30 times, 40 times, 50 times, 60 times, 70 times, 80 times, 90 times, or more, or at least 100 times faster in a target cell or under a first reference condition (which can, e.g., be selected to mimic or represent intracellular conditions) than in the blood of a subject, or under a second reference condition (which can, e.g., be selected to mimic or represent conditions found in the blood or serum).

Cleavable linking groups are susceptible to cleavage agents, e.g., pH, redox potential, or the presence of degradative molecules. Generally, cleavage agents are more prevalent or found at higher levels or activities inside cells than in serum or blood. Examples of such degradative agents include: redox agents which are selected for particular substrates or which have no substrate specificity, including, e.g., oxidative or reductive enzymes or reductive agents such as mercaptans, present in cells, that can degrade a redox cleavable linking group by reduction; esterases; endosomes or agents that can create an acidic environment, e.g., those that result in a pH of five or lower; enzymes that can hydrolyze or degrade an acid cleavable linking group by acting as a general acid, peptidases (which can be substrate specific), and phosphatases.

A cleavable linkage group, such as a disulfide bond can be susceptible to pH. The pH of human serum is 7.4, while the average intracellular pH is slightly lower, ranging from about 7.1-7.3. Endosomes have a more acidic pH, in the range of 5.5-6.0, and lysosomes have an even more acidic pH at around 5.0. Some linkers will have a cleavable linking group that is cleaved at a selected pH, thereby releasing a cationic lipid from the ligand inside the cell, or into the desired compartment of the cell.

A linker can include a cleavable linking group that is cleavable by a particular enzyme. The type of cleavable linking group incorporated into a linker can depend on the cell to be targeted. For example, a liver-targeting ligand can be linked to a cationic lipid through a linker that includes an ester group. Liver cells are rich in esterases, and therefore the linker will be cleaved more efficiently in liver cells than in cell types that are not esterase-rich. Other cell-types rich in esterases include cells of the lung, renal cortex, and testis.

Linkers that contain peptide bonds can be used when targeting cell types rich in peptidases, such as liver cells and synoviocytes.

In general, the suitability of a candidate cleavable linking group can be evaluated by testing the ability of a degradative agent (or condition) to cleave the candidate linking group. It will also be desirable to also test the candidate cleavable linking group for the ability to resist cleavage in the blood or when in contact with other non-target tissue. Thus, one can determine the relative susceptibility to cleavage between a first and a second condition, where the first is selected to be indicative of cleavage in a target cell and the second is selected to be indicative of cleavage in other tissues or biological fluids, e.g., blood or serum. The evaluations can be carried out in cell free systems, in cells, in cell culture, in organ or tissue culture, or in whole animals. It can be useful to make initial evaluations in cell-free or culture conditions and to confirm by further evaluations in whole animals. In certain embodiments, useful candidate compounds are cleaved at least about 2, 4, 10, 20, 30, 40, 50, 60, 70, 80, 90, or 100 times faster in the cell (or under in vitro conditions selected to mimic intracellular conditions) as compared to blood or serum (or under in vitro conditions selected to mimic extracellular conditions).

i. Redox Cleavable Linking Groups

In certain embodiments, a cleavable linking group is a redox cleavable linking group that is cleaved upon reduction or oxidation. An example of reductively cleavable linking group is a disulphide linking group (—S—S—). To determine if a candidate cleavable linking group is a suitable "reductively cleavable linking group," or for example is suitable for use with a particular iRNA moiety and particular targeting agent one can look to methods described herein. For example, a candidate can be evaluated by incubation with dithiothreitol (DTT), or other reducing agent using reagents know in the art, which mimic the rate of cleavage which would be observed in a cell, e.g., a target cell. The candidates can also be evaluated under conditions which are selected to mimic blood or serum conditions. In one, candidate compounds are cleaved by at most about 10% in the blood. In other embodiments, useful candidate compounds are degraded at least about 2, 4, 10, 20, 30, 40, 50, 60, 70, 80, 90, or about 100 times faster in the cell (or under in vitro conditions selected to mimic intracellular conditions) as compared to blood (or under in vitro conditions selected to mimic extracellular conditions). The rate of cleavage of candidate compounds can be determined using standard enzyme kinetics assays under conditions chosen to mimic intracellular media and compared to conditions chosen to mimic extracellular media.

ii. Phosphate-Based Cleavable Linking Groups

In other embodiments, a cleavable linker comprises a phosphate-based cleavable linking group. A phosphate-based cleavable linking group is cleaved by agents that degrade or hydrolyze the phosphate group. An example of an agent that cleaves phosphate groups in cells are enzymes such as phosphatases in cells. Examples of phosphate-based linking groups are —O—P(O)(ORk)-O—, —O—P(S)(ORk)-O—, —O—P(S)(SRk)-O—, —S—P(O)(ORk)-O—, —O—P(O)(ORk)-S—, —S—P(O)(ORk)-S—, —O—P(S)(ORk)-S—, —S—P(S)(ORk)-O—, —O—P(O)(Rk)-O—, —O—P(S)(Rk)-O—, —S—P(O)(Rk)-O—, —S—P(S)(Rk)-O—, —S—P(O)(Rk)-S—, —O—P(S)(Rk)-S—, wherein Rk at each occurrence can be, independently, C1-C20 alkyl, C1-C20 haloalkyl, C6-C10 aryl, or C7-C12 aralkyl. Exemplary embodiments include —O—P(O)(OH)—O—, —O—P(S)(OH)—O—, —O—P(S)(SH)—O—, —S—P(O)(OH)—O—, —O—P(O)(OH)—S—, —S—P(O)(OH)—S—, —O—P(S)(OH)—S—, —S—P(S)(OH)—O—, —O—P(O)(H)—O—, —O—P(S)(H)—O—, —S—P(O)(H)—O, —S—P(S)(H)—O—, —S—P(O)(H)—S—, and —O—P(S)(H)—S—. In certain embodiments a phosphate-based linking group is —O—P(O)(OH)—O—. These candidates can be evaluated using methods analogous to those described above.

iii. Acid Cleavable Linking Groups

In other embodiments, a cleavable linker comprises an acid cleavable linking group. An acid cleavable linking group is a linking group that is cleaved under acidic conditions. In certain embodiments acid cleavable linking groups are cleaved in an acidic environment with a pH of about 6.5 or lower (e.g., about 6.0, 5.5, 5.0, or lower), or by agents such as enzymes that can act as a general acid. In a cell, specific low pH organelles, such as endosomes and lysosomes can provide a cleaving environment for acid cleavable linking groups. Examples of acid cleavable linking groups include but are not limited to hydrazones, esters, and esters of amino acids. Acid cleavable groups can have the general formula —C=NN—, C(O)O, or —OC(O). An exemplary embodiment is when the carbon attached to the oxygen of the ester (the alkoxy group) is an aryl group, substituted alkyl group, or tertiary alkyl group such as dimethyl pentyl or t-butyl. These candidates can be evaluated using methods analogous to those described above.

iv. Ester-Based Linking Groups

In other embodiments, a cleavable linker comprises an ester-based cleavable linking group. An ester-based cleavable linking group is cleaved by enzymes such as esterases and amidases in cells. Examples of ester-based cleavable linking groups include, but are not limited to, esters of alkylene, alkenylene and alkynylene groups. Ester cleavable linking groups have the general formula —C(O)O—, or —OC(O)—. These candidates can be evaluated using methods analogous to those described above.

v. Peptide-Based Cleaving Groups

In yet other embodiments, a cleavable linker comprises a peptide-based cleavable linking group. A peptide-based cleavable linking group is cleaved by enzymes such as peptidases and proteases in cells. Peptide-based cleavable linking groups are peptide bonds formed between amino acids to yield oligopeptides (e.g., dipeptides, tripeptides etc.) and polypeptides. Peptide-based cleavable groups do not include the amide group (—C(O)NH—). The amide group can be formed between any alkylene, alkenylene or alkynelene. A peptide bond is a special type of amide bond formed between amino acids to yield peptides and proteins. The peptide based cleavage group is generally limited to the peptide bond (i.e., the amide bond) formed between amino acids yielding peptides and proteins and does not include the entire amide functional group. Peptide-based cleavable linking groups have the general formula —NHCHRAC(O)NHCHRBC(O)—, where RA and RB are the R groups of the two adjacent amino acids. These candidates can be evaluated using methods analogous to those described above.

In some embodiments, an iRNA of the invention is conjugated to a carbohydrate through a linker. Non-limiting examples of iRNA carbohydrate conjugates with linkers of the compositions and methods of the invention include, but are not limited to,

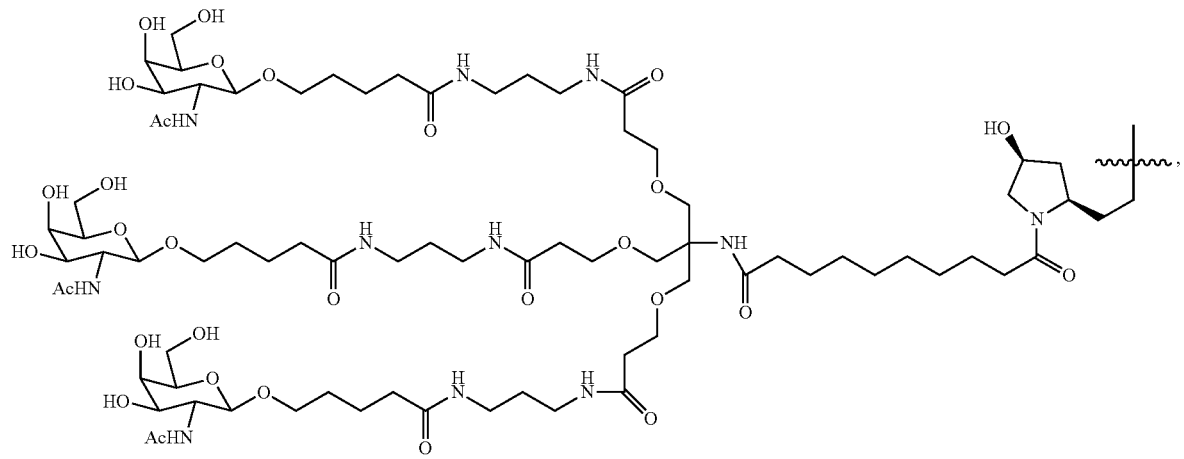

(Formula XXXVII)

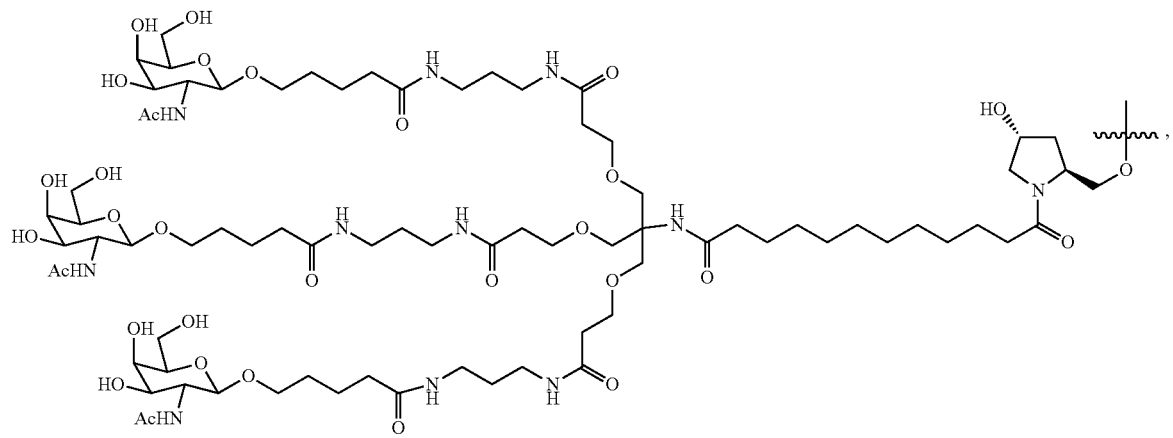

(Formula XXXVIII)

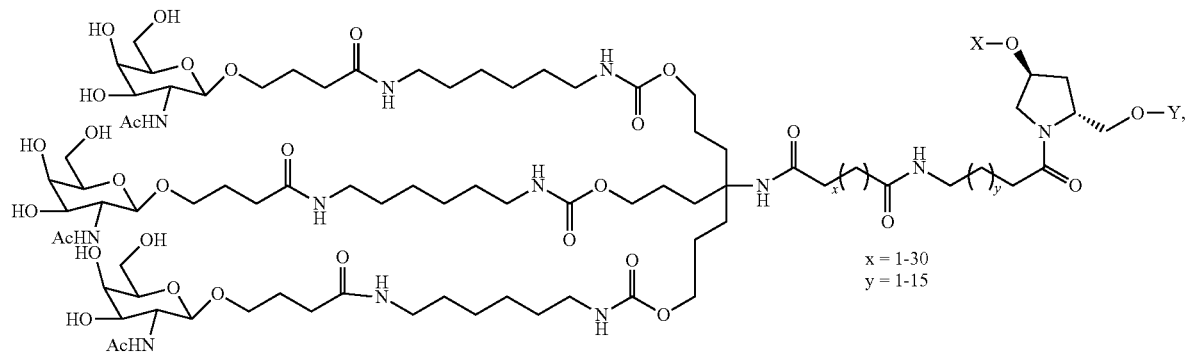

(Formula XXXIX)

x = 1-30
y = 1-15

(Formula XL)
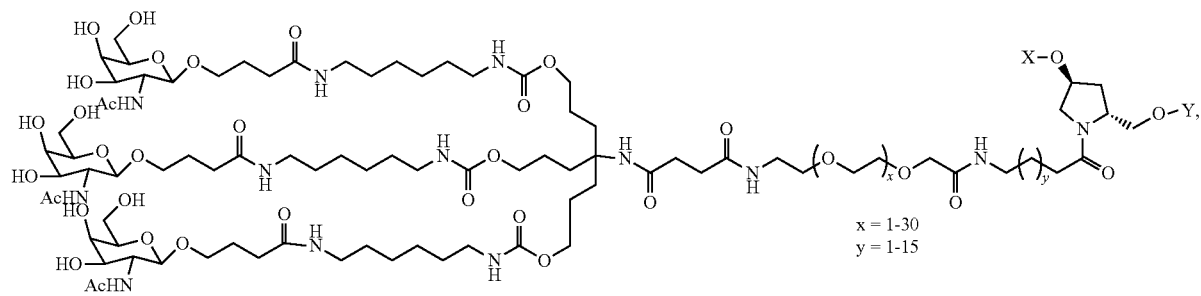
x = 1-30
y = 1-15
(Formula XLI)
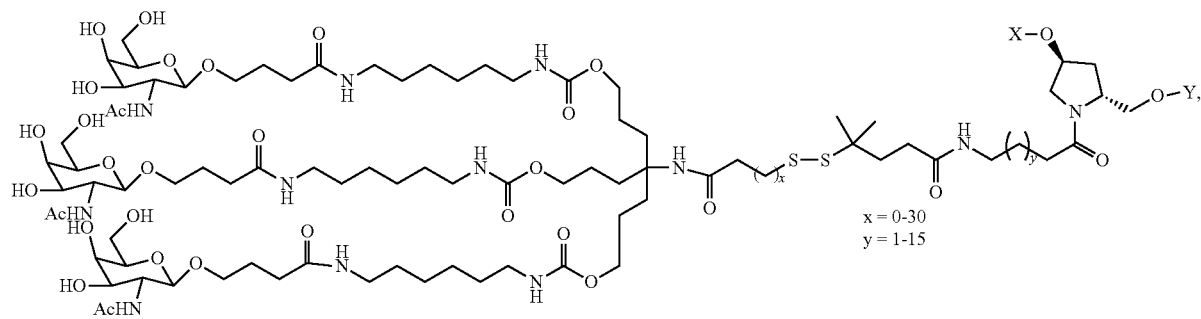
x = 0-30
y = 1-15
(Formula XLII)
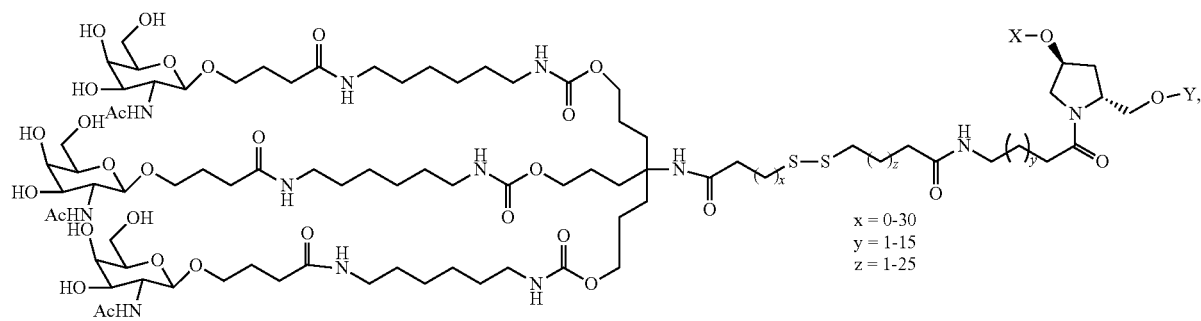
x = 0-30
y = 1-15
z = 1-25
(Formula XLIII)
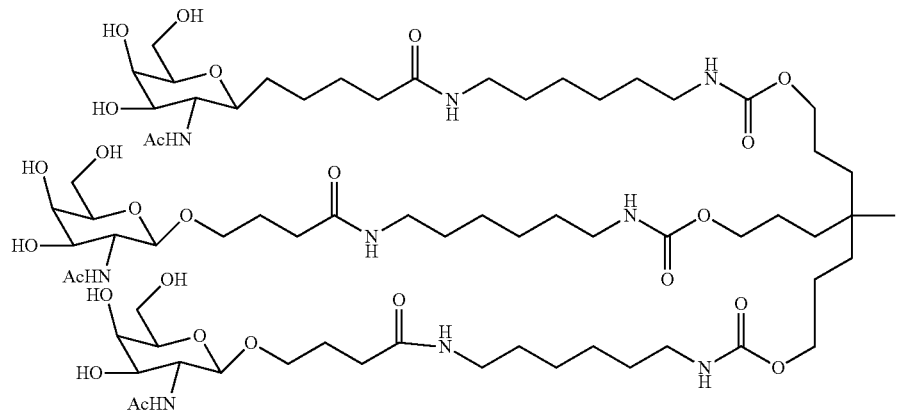

-continued

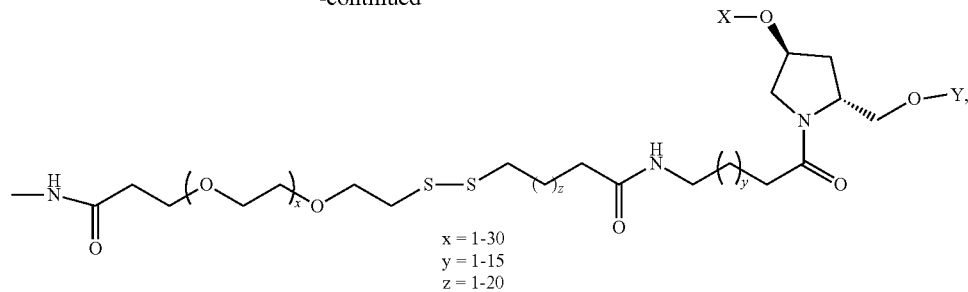

(Formula XLIV)

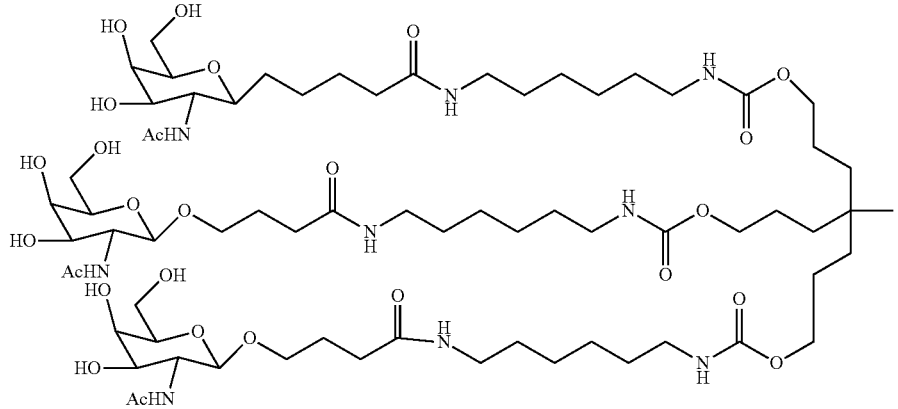

and

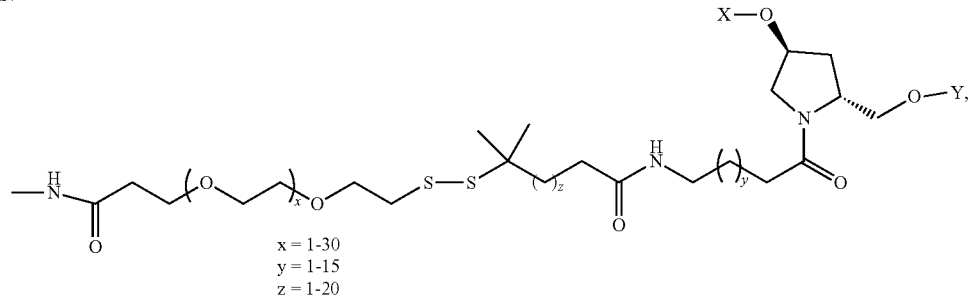

when one of X or Y is an oligonucleotide, the other is a hydrogen.

In certain embodiments of the compositions and methods of the invention, a ligand is one or more "GalNAc" (N-acetylgalactosamine) derivatives attached through a bivalent or trivalent branched linker.

In one embodiment, a dsRNA of the invention is conjugated to a bivalent or trivalent branched linker selected from the group of structures shown in any of formula (XLV)-(XLVI):

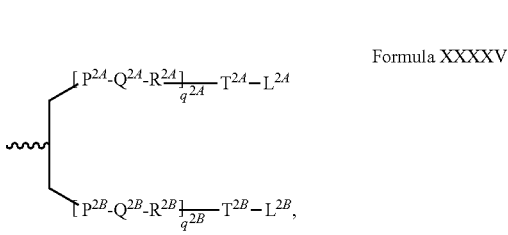

Formula XXXXV

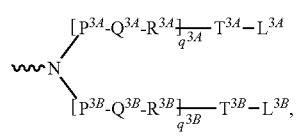

Formula XLVI

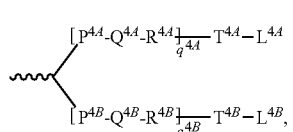

Formula XLVII

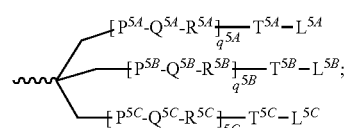

Formula XLVIII wherein:
q2A, q2B, q3A, q3B, q4A, q4B, q5A, q5B and q5C represent independently for each occurrence 0-20 and wherein the repeating unit can be the same or different;
$P^{2A}$, $P^{2B}$, $P^{3A}$, $P^{3B}$, $P^{4A}$, $P^{4B}$, $P^{5A}$, $P^{5B}$, $P^{5C}$, $T^{2A}$, $T^{2B}$, $T^{3A}$, $T^{3B}$, $T^{4A}$, $T^{4B}$, $T^{4A}$, $T^{5B}$, $T^{5C}$ are each independently for each occurrence absent, CO, NH, O, S, OC(O), NHC(O), CH$_2$, CH$_2$NH or CH$_2$O;

Q$^{2A}$, Q$^{2B}$, Q$^{3A}$, Q$^{3B}$, Q$^{4A}$, Q$^{4B}$, Q$^{5A}$, Q$^{5B}$, Q$^{5C}$ are independently for each occurrence absent, alkylene, substituted alkylene wherein one or more methylenes can be interrupted or terminated by one or more of O, S, S(O), SO$_2$, N(R$^N$), C(R')=C(R"), C≡C or C(O);

R$^{2A}$, R$^{2B}$, R$^{3A}$, R$^{3B}$, R$^{4A}$, R$^{4B}$, R$^{5A}$, R$^{5B}$, R$^{5C}$ are each independently for each occurrence absent, NH, O, S, CH$_2$, C(O)O, C(O)NH, NHCH(R$^a$)C(O), —C(O)—CH(R$^a$)—NH—, CO, CH=N—O,

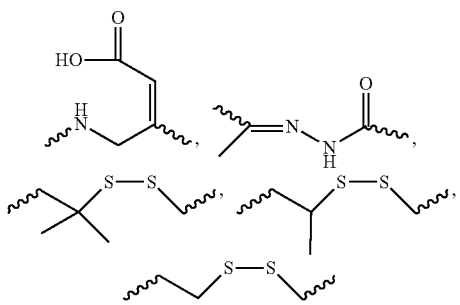

or heterocyclyl;

L$^{2A}$, L$^{2B}$, L$^{3A}$, L$^{3B}$, L$^{4A}$, L$^{4B}$, L$^{5A}$, L$^{5B}$ and L$^{5C}$ represent the ligand; i.e. each independently for each occurrence a monosaccharide (such as GalNAc), disaccharide, trisaccharide, tetrasaccharide, oligosaccharide, or polysaccharide; and R$^a$ is H or amino acid side chain. Trivalent conjugating GalNAc derivatives are particularly useful for use with RNAi agents for inhibiting the expression of a target gene, such as those of formula (XLIX):

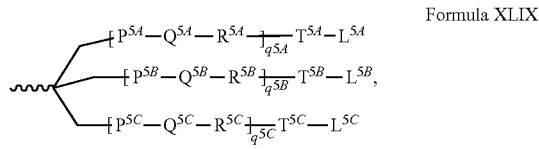

Formula XLIX wherein L$^{5A}$, L$^{5B}$ and L$^{5C}$ represent a monosaccharide, such as GalNAc derivative.

Examples of suitable bivalent and trivalent branched linker groups conjugating GalNAc derivatives include, but are not limited to, the structures recited above as formulas II, VII, XI, X, and XIII.

Representative U.S. patents that teach the preparation of RNA conjugates include, but are not limited to, U.S. Pat. Nos. 4,828,979; 4,948,882; 5,218,105; 5,525,465; 5,541,313; 5,545,730; 5,552,538; 5,578,717; 5,580,731; 5,591,584; 5,109,124; 5,118,802; 5,138,045; 5,414,077; 5,486,603; 5,512,439; 5,578,718; 5,608,046; 4,587,044; 4,605,735; 4,667,025; 4,762,779; 4,789,737; 4,824,941; 4,835,263; 4,876,335; 4,904,582; 4,958,013; 5,082,830; 5,112,963; 5,214,136; 5,082,830; 5,112,963; 5,214,136; 5,245,022; 5,254,469; 5,258,506; 5,262,536; 5,272,250; 5,292,873; 5,317,098; 5,371,241; 5,391,723; 5,416,203, 5,451,463; 5,510,475; 5,512,667; 5,514,785; 5,565,552; 5,567,810; 5,574,142; 5,585,481; 5,587,371; 5,595,726; 5,597,696; 5,599,923; 5,599,928; 5,688,941; 6,294,664; 6,320,017; 6,576,752; 6,783,931; 6,900,297; 7,037,646; and 8,106,022, the entire contents of each of which are hereby incorporated herein by reference.

It is not necessary for all positions in a given compound to be uniformly modified, and in fact more than one of the aforementioned modifications can be incorporated in a single compound or even at a single nucleoside within an iRNA. The present invention also includes iRNA compounds that are chimeric compounds.

"Chimeric" iRNA compounds or "chimeras," in the context of this invention, are iRNA compounds, such as, dsRNAi agents, that contain two or more chemically distinct regions, each made up of at least one monomer unit, i.e., a nucleotide in the case of a dsRNA compound. These iRNAs typically contain at least one region wherein the RNA is modified so as to confer upon the iRNA increased resistance to nuclease degradation, increased cellular uptake, or increased binding affinity for the target nucleic acid. An additional region of the iRNA can serve as a substrate for enzymes capable of cleaving RNA:DNA or RNA:RNA hybrids. By way of example, RNase H is a cellular endonuclease which cleaves the RNA strand of an RNA:DNA duplex. Activation of RNase H, therefore, results in cleavage of the RNA target, thereby greatly enhancing the efficiency of iRNA inhibition of gene expression. Consequently, comparable results can often be obtained with shorter iRNAs when chimeric dsRNAs are used, compared to phosphorothioate deoxy dsRNAs hybridizing to the same target region. Cleavage of the RNA target can be routinely detected by gel electrophoresis and, if necessary, associated nucleic acid hybridization techniques known in the art.

In certain instances, the RNA of an iRNA can be modified by a non-ligand group. A number of non-ligand molecules have been conjugated to iRNAs in order to enhance the activity, cellular distribution or cellular uptake of the iRNA, and procedures for performing such conjugations are available in the scientific literature. Such non-ligand moieties have included lipid moieties, such as cholesterol (Kubo, T. et al., *Biochem. Biophys. Res. Comm.*, 2007, 365(1):54-61; Letsinger et al., *Proc. Natl. Acad. Sci. USA*, 1989, 86:6553), cholic acid (Manoharan et al., *Bioorg. Med. Chem. Lett.*, 1994, 4:1053), a thioether, e.g., hexyl-S-tritylthiol (Manoharan et al., *Ann. N.Y. Acad. Sci.*, 1992, 660:306; Manoharan et al., *Bioorg. Med. Chem. Let.*, 1993, 3:2765), a thiocholesterol (Oberhauser et al., *Nucl. Acids Res.*, 1992, 20:533), an aliphatic chain, e.g., dodecandiol or undecyl residues (Saison-Behmoaras et al., *EMBO J.*, 1991, 10:111; Kabanov et al., *FEBS Lett.*, 1990, 259:327; Svinarchuk et al., *Biochimie*, 1993, 75:49), a phospholipid, e.g., di-hexadecyl-rac-glycerol or triethylammonium 1,2-di-O-hexadecyl-rac-glycero-3-H-phosphonate (Manoharan et al., *Tetrahedron Lett.*, 1995, 36:3651; Shea et al., *Nucl. Acids Res.*, 1990, 18:3777), a polyamine or a polyethylene glycol chain (Manoharan et al., *Nucleosides & Nucleotides*, 1995, 14:969), or adamantane acetic acid (Manoharan et al., *Tetrahedron Lett.*, 1995, 36:3651), a palmityl moiety (Mishra et al., *Biochim. Biophys. Acta*, 1995, 1264:229), or an octadecylamine or hexylamino-carbonyl-oxycholesterol moiety (Crooke et al., *J. Pharmacol. Exp. Ther.*, 1996, 277:923). Representative United States patents that teach the preparation of such RNA conjugates have been listed above. Typical conjugation protocols involve the synthesis of RNAs bearing an aminolinker at one or more positions of the sequence. The amino group is then reacted with the molecule being conjugated using appropriate coupling or activating reagents. The conjugation reaction can be performed either with the RNA still bound to the solid support or following cleavage of the RNA, in solution phase. Purification of the RNA conjugate by HPLC typically affords the pure conjugate.

IV. Delivery of an iRNA of the Invention

The delivery of an iRNA of the invention to a cell e.g., a cell within a subject, such as a human subject (e.g., a subject in need thereof, such as a subject susceptible to or diagnosed with an ANGPTL3-associated disorder, e.g., a disorder of lipid metabolism) can be achieved in a number of different ways. For example, delivery may be performed by contacting a cell with an iRNA of the invention either in vitro or in vivo. In vivo delivery may also be performed directly by administering a composition comprising an iRNA, e.g., a dsRNA, to a subject. Alternatively, in vivo delivery may be performed indirectly by administering one or more vectors that encode and direct the expression of the iRNA. These alternatives are discussed further below.

In general, any method of delivering a nucleic acid molecule (in vitro or in vivo) can be adapted for use with an iRNA of the invention (see e.g., Akhtar S. and Julian R L. (1992) *Trends Cell. Biol.* 2(5):139-144 and WO94/02595, which are incorporated herein by reference in their entireties). For in vivo delivery, factors to consider in order to deliver an iRNA molecule include, for example, biological stability of the delivered molecule, prevention of non-specific effects, and accumulation of the delivered molecule in the target tissue. RNA interference has also shown success with local delivery to the CNS by direct injection (Dorn, G., et al. (2004) *Nucleic Acids* 32:e49; Tan, P H., et al (2005) *Gene Ther.* 12:59-66; Makimura, H., et al (2002) *BMC Neurosci.* 3:18; Shishkina, G T., et al (2004) *Neuroscience* 129:521-528; Thakker, E R., et al (2004) *Proc. Natl. Acad. Sci. U.S.A.* 101:17270-17275; Akaneya, Y., et al (2005) *J. Neurophysiol.* 93:594-602). Modification of the RNA or the pharmaceutical carrier can also permit targeting of the iRNA to the target tissue and avoid undesirable off-target effects. iRNA molecules can be modified by chemical conjugation to lipophilic groups such as cholesterol to enhance cellular uptake and prevent degradation. For example, an iRNA directed against ApoB conjugated to a lipophilic cholesterol moiety was injected systemically into mice and resulted in knockdown of apoB mRNA in both the liver and jejunum (Soutschek, J., et al (2004) *Nature* 432:173-178).

In an alternative embodiment, the iRNA can be delivered using drug delivery systems such as a nanoparticle, a dendrimer, a polymer, liposomes, or a cationic delivery system. Positively charged cationic delivery systems facilitate binding of an iRNA molecule (negatively charged) and also enhance interactions at the negatively charged cell membrane to permit efficient uptake of an iRNA by the cell. Cationic lipids, dendrimers, or polymers can either be bound to an iRNA, or induced to form a vesicle or micelle (see e.g., Kim S H, et al (2008) *Journal of Controlled Release* 129(2):107-116) that encases an iRNA. The formation of vesicles or micelles further prevents degradation of the iRNA when administered systemically. Methods for making and administering cationic-iRNA complexes are well within the abilities of one skilled in the art (see e.g., Sorensen, D R, et al (2003) *J. Mol. Biol* 327:761-766; Verma, U N, et al (2003) *Clin. Cancer Res.* 9:1291-1300; Arnold, A S et al (2007) *J. Hypertens.* 25:197-205, which are incorporated herein by reference in their entirety). Some non-limiting examples of drug delivery systems useful for systemic delivery of iRNAs include DOTAP (Sorensen, D R., et al (2003), supra; Verma, U N, et al (2003), supra), "solid nucleic acid lipid particles" (Zimmermann, T S, et al (2006) *Nature* 441:111-114), cardiolipin (Chien, P Y, et al (2005) *Cancer Gene Ther.* 12:321-328; Pal, A, et al (2005) *Int J. Oncol.* 26:1087-1091), polyethyleneimine (Bonnet M E, et al (2008) *Pharm. Res.* August 16 Epub ahead of print; Aigner, A. (2006) *J. Biomed. Biotechnol.* 71659), Arg-Gly-Asp (RGD) peptides (Liu, S. (2006) *Mol. Pharm.* 3:472-487), and polyamidoamines (Tomalia, D A, et al (2007) *Biochem. Soc. Trans.* 35:61-67; Yoo, H., et al (1999) *Pharm. Res.* 16:1799-1804). In some embodiments, an iRNA forms a complex with cyclodextrin for systemic administration. Methods for administration and pharmaceutical compositions of iRNAs and cyclodextrins can be found in U.S. Pat. No. 7,427,605, which is herein incorporated by reference in its entirety.

A. Vector Encoded iRNAs of the Invention iRNA targeting the ANGPTL3 gene can be expressed from transcription units inserted into DNA or RNA vectors (see, e.g., Couture, A, et al., *TIG.* (1996), 12:5-10; Skillern, A, et al., International PCT Publication No. WO 00/22113, Conrad, International PCT Publication No. WO 00/22114, and Conrad, U.S. Pat. No. 6,054,299). Expression can be transient (on the order of hours to weeks) or sustained (weeks to months or longer), depending upon the specific construct used and the target tissue or cell type. These transgenes can be introduced as a linear construct, a circular plasmid, or a viral vector, which can be an integrating or non-integrating vector. The transgene can also be constructed to permit it to be inherited as an extrachromosomal plasmid (Gassmann, et al., *Proc. Natl. Acad. Sci. USA* (1995) 92:1292).

Viral vector systems which can be utilized with the methods and compositions described herein include, but are not limited to, (a) adenovirus vectors; (b) retrovirus vectors, including but not limited to lentiviral vectors, moloney murine leukemia virus, etc.; (c) adeno-associated virus vectors; (d) herpes simplex virus vectors; (e) SV 40 vectors; (f) polyoma virus vectors; (g) papilloma virus vectors; (h) picornavirus vectors; (i) pox virus vectors such as an orthopox, e.g., vaccinia virus vectors or avipox, e.g. canary pox or fowl pox; and (j) a helper-dependent or gutless adenovirus. Replication-defective viruses can also be advantageous. Different vectors will or will not become incorporated into the cells' genome. The constructs can include viral sequences for transfection, if desired. Alternatively, the construct can be incorporated into vectors capable of episomal replication, e.g. EPV and EBV vectors. Constructs for the recombinant expression of an iRNA will generally require regulatory elements, e.g., promoters, enhancers, etc., to ensure the expression of the iRNA in target cells. Other aspects to consider for vectors and constructs are known in the art.

V. Pharmaceutical Compositions of the Invention

The present invention also includes pharmaceutical compositions and formulations which include the iRNAs of the invention. In one embodiment, provided herein are pharmaceutical compositions containing an iRNA, as described herein, and a pharmaceutically acceptable carrier. The pharmaceutical compositions containing the iRNA are useful for preventing or treating an ANGPTL3-associated disorder, e.g., a disorder of lipid metabolism. Such pharmaceutical compositions are formulated based on the mode of delivery. One example is compositions that are formulated for systemic administration via parenteral delivery, e.g., by subcutaneous (SC), intramuscular (IM), or intravenous (IV) delivery. The pharmaceutical compositions of the invention may be administered in dosages sufficient to inhibit expression of an ANGPTL3 gene.

In some embodiments, the pharmaceutical compositions of the invention are sterile. In another embodiment, the pharmaceutical compositions of the invention are pyrogen free.

The pharmaceutical compositions of the invention may be administered in dosages sufficient to inhibit expression of an ANGPTL3 gene. In general, a suitable dose of an iRNA of the invention will be in the range of about 0.001 to about 200.0 milligrams per kilogram body weight of the recipient per day, generally in the range of about 1 to 50 mg per kilogram body weight per day. Typically, a suitable dose of an iRNA of the invention will be in the range of about 0.1 mg/kg to about 5.0 mg/kg, such as, about 0.3 mg/kg and about 3.0 mg/kg. A repeat-dose regimen may include administration of a therapeutic amount of iRNA on a regular basis, such as every month, once every 3-6 months, or once a year. In certain embodiments, the iRNA is administered about once per month to about once per six months.

After an initial treatment regimen, the treatments can be administered on a less frequent basis. Duration of treatment can be determined based on the severity of disease.

In other embodiments, a single dose of the pharmaceutical compositions can be long lasting, such that doses are administered at not more than 1, 2, 3, or 4 month intervals. In some embodiments of the invention, a single dose of the pharmaceutical compositions of the invention is administered about once per month. In other embodiments of the invention, a single dose of the pharmaceutical compositions of the invention is administered quarterly (i.e., about every three months). In other embodiments of the invention, a single dose of the pharmaceutical compositions of the invention is administered twice per year (i.e., about once every six months).

The skilled artisan will appreciate that certain factors can influence the dosage and timing required to effectively treat a subject, including but not limited to mutations present in the subject, previous treatments, the general health or age of the subject, and other diseases present. Moreover, treatment of a subject with a prophylactically or therapeutically effective amount, as appropriate, of a composition can include a single treatment or a series of treatments.

The iRNA can be delivered in a manner to target a particular tissue (e.g., hepatocytes).

Pharmaceutical compositions of the present invention include, but are not limited to, solutions, emulsions, and liposome-containing formulations. These compositions can be generated from a variety of components that include, but are not limited to, preformed liquids, self-emulsifying solids, and self-emulsifying semisolids. Formulations include those that target the liver.

The pharmaceutical formulations of the present invention, which can conveniently be presented in unit dosage form, can be prepared according to conventional techniques well known in the pharmaceutical industry. Such techniques include the step of bringing into association the active ingredients with the pharmaceutical carrier(s) or excipient(s). In general, the formulations are prepared by uniformly and intimately bringing into association the active ingredients with liquid carriers.

A. Additional Formulations i. Emulsions

The compositions of the present invention can be prepared and formulated as emulsions. Emulsions are typically heterogeneous systems of one liquid dispersed in another in the form of droplets usually exceeding 0.1 μm in diameter (see e.g., Ansel's Pharmaceutical Dosage Forms and Drug Delivery Systems, Allen, L V., Popovich N G., and Ansel H C., 2004, Lippincott Williams & Wilkins (8th ed.), New York, NY; Idson, in Pharmaceutical Dosage Forms, Lieberman, Rieger and Banker (Eds.), 1988, Marcel Dekker, Inc., New York, N.Y., volume 1, p. 199; Rosoff, in Pharmaceutical Dosage Forms, Lieberman, Rieger and Banker (Eds.), 1988, Marcel Dekker, Inc., New York, N.Y., Volume 1, p. 245; Block in Pharmaceutical Dosage Forms, Lieberman, Rieger and Banker (Eds.), 1988, Marcel Dekker, Inc., New York, N.Y., volume 2, p. 335; Higuchi et al., in Remington's Pharmaceutical Sciences, Mack Publishing Co., Easton, Pa., 1985, p. 301). Emulsions are often biphasic systems comprising two immiscible liquid phases intimately mixed and dispersed with each other. In general, emulsions can be of either the water-in-oil (w/o) or the oil-in-water (o/w) variety. When an aqueous phase is finely divided into and dispersed as minute droplets into a bulk oily phase, the resulting composition is called a water-in-oil (w/o) emulsion. Alternatively, when an oily phase is finely divided into and dispersed as minute droplets into a bulk aqueous phase, the resulting composition is called an oil-in-water (o/w) emulsion. Emulsions can contain additional components in addition to the dispersed phases, and the active drug which can be present as a solution either in the aqueous phase, oily phase or itself as a separate phase. Pharmaceutical excipients such as emulsifiers, stabilizers, dyes, and anti-oxidants can also be present in emulsions as needed. Pharmaceutical emulsions can also be multiple emulsions that are comprised of more than two phases such as, for example, in the case of oil-in-water-in-oil (o/w/o) and water-in-oil-in-water (w/o/w) emulsions. Such complex formulations often provide certain advantages that simple binary emulsions do not. Multiple emulsions in which individual oil droplets of an o/w emulsion enclose small water droplets constitute a w/o/w emulsion. Likewise a system of oil droplets enclosed in globules of water stabilized in an oily continuous phase provides an o/w/o emulsion.

Emulsions are characterized by little or no thermodynamic stability. Often, the dispersed or discontinuous phase of the emulsion is well dispersed into the external or continuous phase and maintained in this form through the means of emulsifiers or the viscosity of the formulation. Other means of stabilizing emulsions entail the use of emulsifiers that can be incorporated into either phase of the emulsion. Emulsifiers can broadly be classified into four categories: synthetic surfactants, naturally occurring emulsifiers, absorption bases, and finely dispersed solids (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y.; Idson, in Pharmaceutical Dosage Forms, Lieberman, Rieger and Banker (Eds.), 1988, Marcel Dekker, Inc., New York, N.Y., volume 1, p. 199).

Synthetic surfactants, also known as surface active agents, have found wide applicability in the formulation of emulsions and have been reviewed in the literature (see e.g., Ansel's Pharmaceutical Dosage Forms and Drug Delivery Systems, Allen, L V., Popovich N G., and Ansel H C., 2004, Lippincott Williams & Wilkins (8th ed.), New York, NY; Rieger, in Pharmaceutical Dosage Forms, Lieberman, Rieger and Banker (Eds.), 1988, Marcel Dekker, Inc., New York, N.Y., volume 1, p. 285; Idson, in Pharmaceutical Dosage Forms, Lieberman, Rieger and Banker (Eds.), Marcel Dekker, Inc., New York, N.Y., 1988, volume 1, p. 199). Surfactants are typically amphiphilic and comprise a hydrophilic and a hydrophobic portion. The ratio of the hydrophilic to the hydrophobic nature of the surfactant has been termed the hydrophile/lipophile balance (HLB) and is a valuable tool in categorizing and selecting surfactants in the preparation of formulations. Surfactants can be classified into different classes based on the nature of the hydrophilic group: nonionic, anionic, cationic, and amphoteric (see e.g., Ansel's Pharmaceutical Dosage Forms and Drug Delivery Systems, Allen, L V., Popovich N G., and Ansel H C., 2004, Lippincott Williams & Wilkins (8th ed.), New York, NY Rieger, in Pharmaceutical Dosage Forms, Lieberman, Rieger and Banker (Eds.), 1988, Marcel Dekker, Inc., New York, N.Y., volume 1, p. 285).

A large variety of non-emulsifying materials are also included in emulsion formulations and contribute to the properties of emulsions. These include fats, oils, waxes, fatty acids, fatty alcohols, fatty esters, humectants, hydrophilic colloids, preservatives, and antioxidants (Block, in Pharmaceutical Dosage Forms, Lieberman, Rieger and Banker (Eds.), 1988, Marcel Dekker, Inc., New York, N.Y., volume 1, p. 335; Idson, in Pharmaceutical Dosage Forms, Lieberman, Rieger and Banker (Eds.), 1988, Marcel Dekker, Inc., New York, N.Y., volume 1, p. 199).

The application of emulsion formulations via dermatological, oral, and parenteral routes, and methods for their manufacture have been reviewed in the literature (see e.g., Ansel's Pharmaceutical Dosage Forms and Drug Delivery Systems, Allen, L V., Popovich N G., and Ansel H C., 2004, Lippincott Williams & Wilkins (8th ed.), New York, NY; Idson, in Pharmaceutical Dosage Forms, Lieberman, Rieger and Banker (Eds.), 1988, Marcel Dekker, Inc., New York, N.Y., volume 1, p. 199).

ii. Microemulsions

In one embodiment of the present invention, the compositions of iRNAs and nucleic acids are formulated as microemulsions. A microemulsion can be defined as a system of water, oil, and amphiphile which is a single optically isotropic and thermodynamically stable liquid solution (see e.g., Ansel's Pharmaceutical Dosage Forms and Drug Delivery Systems, Allen, L V., Popovich N G., and Ansel H C., 2004, Lippincott Williams & Wilkins (8th ed.), New York, NY; Rosoff, in Pharmaceutical Dosage Forms, Lieberman, Rieger and Banker (Eds.), 1988, Marcel Dekker, Inc., New York, N.Y., volume 1, p. 245). Typically microemulsions are systems that are prepared by first dispersing an oil in an aqueous surfactant solution and then adding a sufficient amount of a fourth component, generally an intermediate chain-length alcohol to form a transparent system. Therefore, microemulsions have also been described as thermodynamically stable, isotropically clear dispersions of two immiscible liquids that are stabilized by interfacial films of surface-active molecules (Leung and Shah, in: Controlled Release of Drugs: Polymers and Aggregate Systems, Rosoff, M., Ed., 1989, VCH Publishers, New York, pages 185-215).

iii. Microparticles

An iRNA of the invention may be incorporated into a particle, e.g., a microparticle. Microparticles can be produced by spray-drying, but may also be produced by other methods including lyophilization, evaporation, fluid bed drying, vacuum drying, or a combination of these techniques.

iv. Penetration Enhancers

In one embodiment, the present invention employs various penetration enhancers to effect the efficient delivery of nucleic acids, particularly iRNAs, to the skin of animals Most drugs are present in solution in both ionized and nonionized forms. However, usually only lipid soluble or lipophilic drugs readily cross cell membranes. It has been discovered that even non-lipophilic drugs can cross cell membranes if the membrane to be crossed is treated with a penetration enhancer. In addition to aiding the diffusion of non-lipophilic drugs across cell membranes, penetration enhancers also enhance the permeability of lipophilic drugs.

Penetration enhancers can be classified as belonging to one of five broad categories, i.e., surfactants, fatty acids, bile salts, chelating agents, and non-chelating non-surfactants (see e.g., Malmsten, M. Surfactants and polymers in drug delivery, Informa Health Care, New York, NY, 2002; Lee et al., Critical Reviews in Therapeutic Drug Carrier Systems, 1991, p. 92). Each of the above mentioned classes of penetration enhancers and their use in manufacture of pharmaceutical compositions and delivery of pharmaceutical agents are well known in the art.

v. Excipients

In contrast to a carrier compound, a "pharmaceutical carrier" or "excipient" is a pharmaceutically acceptable solvent, suspending agent, or any other pharmacologically inert vehicle for delivering one or more nucleic acids to an animal. The excipient can be liquid or solid and is selected, with the planned manner of administration in mind, so as to provide for the desired bulk, consistency, etc., when combined with a nucleic acid and the other components of a given pharmaceutical composition. Such agent are well known in the art.

vi. Other Components

The compositions of the present invention can additionally contain other adjunct components conventionally found in pharmaceutical compositions, at their art-established usage levels. Thus, for example, the compositions can contain additional, compatible, pharmaceutically-active materials such as, for example, antipruritics, astringents, local anesthetics or anti-inflammatory agents, or can contain additional materials useful in physically formulating various dosage forms of the compositions of the present invention, such as dyes, flavoring agents, preservatives, antioxidants, opacifiers, thickening agents and stabilizers. However, such materials, when added, should not unduly interfere with the biological activities of the components of the compositions of the present invention. The formulations can be sterilized and, if desired, mixed with auxiliary agents, e.g., lubricants, preservatives, stabilizers, wetting agents, emulsifiers, salts for influencing osmotic pressure, buffers, colorings, flavorings, or aromatic substances, and the like which do not deleteriously interact with the nucleic acid(s) of the formulation.

Aqueous suspensions can contain substances which increase the viscosity of the suspension including, for example, sodium carboxymethylcellulose, sorbitol, or dextran. The suspension can also contain stabilizers.

In some embodiments, pharmaceutical compositions featured in the invention include (a) one or more iRNA and (b) one or more agents which function by a non-iRNA mechanism and which are useful in treating an ANGPTL33-associated disorder, e.g., a disorder of lipid metabolism.

Toxicity and prophylactic efficacy of such compounds can be determined by standard pharmaceutical procedures in cell cultures or experimental animals, e.g., for determining the LD50 (the dose lethal to 50% of the population) and the ED50 (the dose prophylactically effective in 50% of the population). The dose ratio between toxic and therapeutic effects is the therapeutic index and it can be expressed as the ratio LD50/ED50. Compounds that exhibit high therapeutic indices are preferred.

The data obtained from cell culture assays and animal studies can be used in formulating a range of dosage for use in humans. The dosage of compositions featured herein in the invention lies generally within a range of circulating concentrations that include the ED50, such as, an ED80 or ED90, with little or no toxicity. The dosage can vary within this range depending upon the dosage form employed and the route of administration utilized. For any compound used in the methods featured in the invention, the prophylactically effective dose can be estimated initially from cell culture assays. A dose can be formulated in animal models to achieve a circulating plasma concentration range of the compound or, when appropriate, of the polypeptide product of a target sequence (e.g., achieving a decreased concentration of the polypeptide) that includes the IC50 (i.e., the concentration of the test compound which achieves a half-maximal inhibition of symptoms) or higher levels of inhibition as determined in cell culture. Such information can be used to more accurately determine useful doses in humans. Levels in plasma can be measured, for example, by high performance liquid chromatography.

In addition to their administration, as discussed above, the iRNAs featured in the invention can be administered in combination with other known agents used for the prevention or treatment of an ANGPTL3-associated disorder, e.g., a disorder of lipid metabolism. In any event, the administering physician can adjust the amount and timing of iRNA administration on the basis of results observed using standard measures of efficacy known in the art or described herein.

VI. Methods for Inhibiting ANGPTL3 Expression

The present invention also provides methods of inhibiting expression of an ANGPTL3 gene in a cell. The methods include contacting a cell with an RNAi agent, e.g., double stranded RNA agent, in an amount effective to inhibit expression of ANGPTL3 in the cell, thereby inhibiting expression of ANGPTL3 in the cell.

Contacting of a cell with an iRNA, e.g., a double stranded RNA agent, may be done in vitro or in vivo. Contacting a cell in vivo with the iRNA includes contacting a cell or group of cells within a subject, e.g., a human subject, with the iRNA. Combinations of in vitro and in vivo methods of contacting a cell are also possible. Contacting a cell may be direct or indirect, as discussed above. Furthermore, contacting a cell may be accomplished via a targeting ligand, including any ligand described herein or known in the art. In some embodiments, the targeting ligand is a carbohydrate moiety, e.g., a GalNAc$_3$ ligand, or any other ligand that directs the RNAi agent to a site of interest.

The term "inhibiting," as used herein, is used interchangeably with "reducing," "silencing," "downregulating", "suppressing", and other similar terms, and includes any level of inhibition.

The phrase "inhibiting expression of a ANGPTL3" is intended to refer to inhibition of expression of any ANGPTL3 gene (such as, e.g., a mouse ANGPTL3 3 gene, a rat ANGPTL3 gene, a monkey ANGPTL3 gene, or a human ANGPTL3 gene) as well as variants or mutants of a ANGPTL3 gene. Thus, the ANGPTL3 gene may be a wild-type ANGPTL3 gene, a mutant ANGPTL3 gene, or a transgenic ANGPTL3 gene in the context of a genetically manipulated cell, group of cells, or organism.

"Inhibiting expression of an ANGPTL3 gene" includes any level of inhibition of an ANGPTL3 gene, e.g., at least partial suppression of the expression of an ANGPTL3 gene.

The expression of the ANGPTL3 gene may be assessed based on the level, or the change in the level, of any variable associated with ANGPTL3 gene expression, e.g., ANGPTL3 mRNA level or ANGPTL3 protein level. The expression of an ANGPTL3 may also be assessed indirectly based on the levels of a serum lipid, a triglyceride, cholesterol (including LDL-C, HDL-C, VLDL-C, IDL-C and total cholesterol), or free fatty acids. This level may be assessed in an individual cell or in a group of cells, including, for example, a sample derived from a subject. It is understood that ANGPTL3 is expressed predominantly in the liver.

Inhibition may be assessed by a decrease in an absolute or relative level of one or more variables that are associated with ANGPTL3 expression compared with a control level. The control level may be any type of control level that is utilized in the art, e.g., a pre-dose baseline level, or a level determined from a similar subject, cell, or sample that is untreated or treated with a control (such as, e.g., buffer only control or inactive agent control).

In some embodiments of the methods of the invention, expression of an ANGPTL3 gene is inhibited by at least 50%, 55%, 60%, 65%, 70%, 75%, 80%, 85%, 90%, or 95%, or to below the level of detection of the assay. In some embodiments, expression of an ANGPTL3 gene is inhibited by at least 70%. It is further understood that inhibition of ANGPTL3 expression in certain tissues, e.g., in liver, without a significant inhibition of expression in other tissues, e.g., brain, may be desirable. In some embodiments, expression level is determined using the assay method provided in Example 2 with a 10 nM siRNA concentration in the appropriate species matched cell line.

In certain embodiments, inhibition of expression in vivo is determined by knockdown of the human gene in a rodent expressing the human gene, e.g., an AAV-infected mouse expressing the human target gene (i.e., ANGPTL3), e.g., when administered as a single dose, e.g., at 3 mg/kg at the nadir of RNA expression. Knockdown of expression of an endogenous gene in a model animal system can also be determined, e.g., after administration of a single dose at, e.g., 3 mg/kg at the nadir of RNA expression. Such systems are useful when the nucleic acid sequence of the human gene and the model animal gene are sufficiently close such that the human iRNA provides effective knockdown of the model animal gene. RNA expression in liver is determined using the PCR methods provided in Example 2.

Inhibition of the expression of an ANGPTL3 gene may be manifested by a reduction of the amount of mRNA expressed by a first cell or group of cells (such cells may be present, for example, in a sample derived from a subject) in which an ANGPTL3 gene is transcribed and which has or have been treated (e.g., by contacting the cell or cells with an iRNA of the invention, or by administering an iRNA of the invention to a subject in which the cells are or were present) such that the expression of an ANGPTL3 gene is inhibited, as compared to a second cell or group of cells substantially identical to the first cell or group of cells but which has not or have not been so treated (control cell(s) not treated with an iRNA or not treated with an iRNA targeted to the gene of interest). In some embodiments, the inhibition is assessed by the method provided in Example 2 using a 10 nM siRNA concentration in the species matched cell line and expressing the level of mRNA in treated cells as a percentage of the level of mRNA in control cells, using the following formula:

$$\frac{(mRNA \text{ in control cells}) - (mRNA \text{ in treated cells})}{(mRNA \text{ in control cells})} \cdot 100\%$$

In other embodiments, inhibition of the expression of an ANGPTL3 gene may be assessed in terms of a reduction of a parameter that is functionally linked to ANGPTL3 gene expression, e.g., ANGPTL3 protein level in blood or serum from a subject. ANGPTL3 gene silencing may be determined in any cell expressing ANGPTL3, either endogenous or heterologous from an expression construct, and by any assay known in the art.

Inhibition of the expression of an ANGPTL3 protein may be manifested by a reduction in the level of the ANGPTL3 protein that is expressed by a cell or group of cells or in a subject sample (e.g., the level of protein in a blood sample derived from a subject). As explained above, for the assessment of mRNA suppression, the inhibition of protein expression levels in a treated cell or group of cells may similarly be expressed as a percentage of the level of protein in a control cell or group of cells, or the change in the level of protein in a subject sample, e.g., blood or serum derived therefrom.

A control cell, a group of cells, or subject sample that may be used to assess the inhibition of the expression of an ANGPTL3 gene includes a cell, group of cells, or subject sample that has not yet been contacted with an RNAi agent of the invention. For example, the control cell, group of cells, or subject sample may be derived from an individual subject (e.g., a human or animal subject) prior to treatment of the subject with an RNAi agent or an appropriately matched population control.

The level of ANGPTL3 mRNA that is expressed by a cell or group of cells may be determined using any method known in the art for assessing mRNA expression. In one embodiment, the level of expression of ANGPTL3 in a sample is determined by detecting a transcribed polynucleotide, or portion thereof, e.g., mRNA of the ANGPTL3 gene. RNA may be extracted from cells using RNA extraction techniques including, for example, using acid phenol/guanidine isothiocyanate extraction (RNAzol B; Biogenesis), RNeasy™ RNA preparation kits (Qiagen®) or PAXgene™ (PreAnalytix™, Switzerland). Typical assay formats utilizing ribonucleic acid hybridization include nuclear run-on assays, RT-PCR, RNase protection assays, northern blotting, in situ hybridization, and microarray analysis.

In some embodiments, the level of expression of ANGPTL3 is determined using a nucleic acid probe. The term "probe", as used herein, refers to any molecule that is capable of selectively binding to a specific ANGPTL3. Probes can be synthesized by one of skill in the art, or derived from appropriate biological preparations. Probes may be specifically designed to be labeled. Examples of molecules that can be utilized as probes include, but are not limited to, RNA, DNA, proteins, antibodies, and organic molecules.

Isolated mRNA can be used in hybridization or amplification assays that include, but are not limited to, Southern or northern analyses, polymerase chain reaction (PCR) analyses and probe arrays. One method for the determination of mRNA levels involves contacting the isolated mRNA with a nucleic acid molecule (probe) that can hybridize to ANGPTL3 mRNA. In one embodiment, the mRNA is immobilized on a solid surface and contacted with a probe, for example by running the isolated mRNA on an agarose gel and transferring the mRNA from the gel to a membrane, such as nitrocellulose. In an alternative embodiment, the probe(s) are immobilized on a solid surface and the mRNA is contacted with the probe(s), for example, in an Affymetrix® gene chip array. A skilled artisan can readily adapt known mRNA detection methods for use in determining the level of ANGPTL3 mRNA.

An alternative method for determining the level of expression of ANGPTL3 in a sample involves the process of nucleic acid amplification or reverse transcriptase (to prepare cDNA) of for example mRNA in the sample, e.g., by RT-PCR (the experimental embodiment set forth in Mullis, 1987, U.S. Pat. No. 4,683,202), ligase chain reaction (Barany (1991) *Proc. Natl. Acad. Sci. USA* 88:189-193), self sustained sequence replication (Guatelli et al. (1990) *Proc. Natl. Acad. Sci. USA* 87:1874-1878), transcriptional amplification system (Kwoh et al. (1989) *Proc. Natl. Acad. Sci. USA* 86:1173-1177), Q-Beta Replicase (Lizardi et al. (1988) *Bio/Technology* 6:1197), rolling circle replication (Lizardi et al., U.S. Pat. No. 5,854,033) or any other nucleic acid amplification method, followed by the detection of the amplified molecules using techniques well known to those of skill in the art. These detection schemes are especially useful for the detection of nucleic acid molecules if such molecules are present in very low numbers. In particular aspects of the invention, the level of expression of ANGPTL3 is determined by quantitative fluorogenic RT-PCR (i.e., the TaqMan™ System). In some embodiments, expression level is determined by the method provided in Example 2 using, e.g., a 10 nM siRNA concentration, in the species matched cell line.

The expression levels of ANGPTL3 mRNA may be monitored using a membrane blot (such as used in hybridization analysis such as northern, Southern, dot, and the like), or microwells, sample tubes, gels, beads or fibers (or any solid support comprising bound nucleic acids). See U.S. Pat. Nos. 5,770,722, 5,874,219, 5,744,305, 5,677,195 and 5,445,934, which are incorporated herein by reference. The determination of ANGPTL3 expression level may also comprise using nucleic acid probes in solution.

In some embodiments, the level of mRNA expression is assessed using branched DNA (bDNA) assays or real time PCR (qPCR). The use of these methods is described and exemplified in the Examples presented herein. In some embodiments, expression level is determined by the method provided in Example 2 using a 10 nM siRNA concentration in the species matched cell line.

The level of ANGPTL3 protein expression may be determined using any method known in the art for the measurement of protein levels. Such methods include, for example, electrophoresis, capillary electrophoresis, high performance liquid chromatography (HPLC), thin layer chromatography (TLC), hyperdiffusion chromatography, fluid or gel precipitin reactions, absorption spectroscopy, a colorimetric assays, spectrophotometric assays, flow cytometry, immunodiffusion (single or double), immunoelectrophoresis, western blotting, radioimmunoassay (RIA), enzyme-linked immunosorbent assays (ELISAs), immunofluorescent assays, electrochemiluminescence assays, and the like.

In some embodiments, the efficacy of the methods of the invention are assessed by a decrease in ANGPTL3 mRNA or protein level (e.g., in a liver biopsy).

In some embodiments of the methods of the invention, the iRNA is administered to a subject such that the iRNA is delivered to a specific site within the subject. The inhibition of expression of ANGPTL3 may be assessed using measurements of the level or change in the level of ANGPTL3 mRNA or ANGPTL3 protein in a sample derived from fluid or tissue from the specific site within the subject (e.g., liver or blood).

As used herein, the terms detecting or determining a level of an analyte are understood to mean performing the steps to determine if a material, e.g., protein, RNA, is present. As used herein, methods of detecting or determining include detection or determination of an analyte level that is below the level of detection for the method used.

VII. Prophylactic and Treatment Methods of the Invention

The present invention also provides methods of using an iRNA of the invention or a composition containing an iRNA of the invention to inhibit expression of ANGPTL3, thereby preventing or treating an ANGPTL3-associated disorder, e.g., a disorder of lipid metabolism. In the methods of the invention the cell may be contacted with the siRNA in vitro or in vivo, i.e., the cell may be within a subject.

A cell suitable for treatment using the methods of the invention may be any cell that expresses an ANGPTL3 gene, e.g., a liver cell. A cell suitable for use in the methods of the invention may be a mammalian cell, e.g., a primate cell (such as a human cell, including human cell in a chimeric non-human animal, or a non-human primate cell, e.g., a monkey cell or a chimpanzee cell), or a non-primate cell. In certain embodiments, the cell is a human cell, e.g., a human liver cell. In the methods of the invention, ANGPTL3 expression is inhibited in the cell by at least 50, 55, 60, 65, 70, 75, 80, 85, 90, or 95, or to a level below the level of detection of the assay.

The in vivo methods of the invention may include administering to a subject a composition containing an iRNA, where the iRNA includes a nucleotide sequence that is complementary to at least a part of an RNA transcript of the ANGPTL3 gene of the mammal to which the RNAi agent is to be administered. The composition can be administered by any means known in the art including, but not limited to oral, intraperitoneal, or parenteral routes, including intracranial (e.g., intraventricular, intraparenchymal, and intrathecal), intravenous, intramuscular, subcutaneous, transdermal, airway (aerosol), nasal, rectal, and topical (including buccal and sublingual) administration. In certain embodiments, the compositions are administered by intravenous infusion or injection. In certain embodiments, the compositions are administered by subcutaneous injection. In certain embodiments, the compositions are administered by intramuscular injection.

In one aspect, the present invention also provides methods for inhibiting the expression of an ANGPTL3 gene in a mammal. The methods include administering to the mammal a composition comprising a dsRNA that targets an ANGPTL3 gene in a cell of the mammal and maintaining the mammal for a time sufficient to obtain degradation of the mRNA transcript of the ANGPTL3 gene, thereby inhibiting expression of the ANGPTL3 gene in the cell. Reduction in gene expression can be assessed by any methods known in the art and by methods, e.g. qRT-PCR, described herein, e.g., in Example 2. Reduction in protein production can be assessed by any methods known it the art, e.g. ELISA. In certain embodiments, a puncture liver biopsy sample serves as the tissue material for monitoring the reduction in the ANGPTL3 gene or protein expression. In other embodiments, a blood sample serves as the subject sample for monitoring the reduction in the ANGPTL3 protein expression.

The present invention further provides methods of treatment in a subject in need thereof, e.g., a subject diagnosed with an ANGPTL3-associated disorder, such as a disorder of lipid metabolism. In one embodiment, a subject having a disorder of lipid metabolism has hyperlipidemia. In another embodiment, a subject having a disorder of lipid metabolism has hypertriglyceridemia.

The present invention further provides methods of prophylaxis in a subject in need thereof. The treatment methods of the invention include administering an iRNA of the invention to a subject, e.g., a subject that would benefit from a reduction of ANGPTL3 expression, in a prophylactically effective amount of a dsRNA targeting an ANGPTL3 gene or a pharmaceutical composition comprising a dsRNA targeting an ANGPTL3 gene.

In one aspect, the present invention provides methods of treating a subject having a disorder that would benefit from reduction in ANGPTL3 expression, e.g., an ANGPTL3-associated disease, such as a disorder of lipid metabolism, e.g., hyperlipidemia or hypertriglyceridemia. Treatment of a subject that would benefit from a reduction and/or inhibition of ANGPTL3 gene expression includes therapeutic treatment (e.g., a subject is having eruptive xanthomas) and prophylactic treatment (e.g., the subject is not having eruptive xanthomas or a subject may be at risk of developing eruptive xanthomas).

An iRNA of the invention may be administered as a "free iRNA." A free iRNA is administered in the absence of a pharmaceutical composition. The naked iRNA may be in a suitable buffer solution. The buffer solution may comprise acetate, citrate, prolamine, carbonate, or phosphate, or any combination thereof. In one embodiment, the buffer solution is phosphate buffered saline (PBS). The pH and osmolarity of the buffer solution containing the iRNA can be adjusted such that it is suitable for administering to a subject.

Alternatively, an iRNA of the invention may be administered as a pharmaceutical composition, such as a dsRNA liposomal formulation.

Subjects that would benefit from an inhibition of ANGPTL3 gene expression are subjects susceptible to or diagnosed with an ANGPTL3-associated disorder, such as a disorder of lipid metabolism, e.g., hyperlipidemia or hypertriglyceridemia. In an embodiment, the method includes administering a composition featured herein such that expression of the target an ANGPTL3 gene is decreased, such as for about 1, 2, 3, 4, 5, 6, 1-6, 1-3, or 3-6 months per dose. In certain embodiments, the composition is administered once every 3-6 months.

In one embodiment, the iRNAs useful for the methods and compositions featured herein specifically target RNAs (primary or processed) of the target ANGPTL3 gene. Compositions and methods for inhibiting the expression of these genes using iRNAs can be prepared and performed as described herein.

Administration of the iRNA according to the methods of the invention may result prevention or treatment of an ANGPTL3-associated disorder, e.g., a disorder of lipid metabolism, e.g., hyperlipidemia or hypertriglyceridemia. Subjects can be administered a therapeutic amount of iRNA, such as about 0.01 mg/kg to about 200 mg/kg.

In one embodiment, the iRNA is administered subcutaneously, i.e., by subcutaneous injection. One or more injections may be used to deliver the desired dose of iRNA to a subject. The injections may be repeated over a period of time.

The administration may be repeated on a regular basis. In certain embodiments, after an initial treatment regimen, the treatments can be administered on a less frequent basis. A repeat-dose regimen may include administration of a therapeutic amount of iRNA on a regular basis, such as once per month to once a year. In certain embodiments, the iRNA is administered about once per month to about once every three months, or about once every three months to about once every six months.

The invention further provides methods and uses of an iRNA agent or a pharmaceutical composition thereof for treating a subject that would benefit from reduction and/or inhibition of ANGPTL3 gene expression, e.g., a subject having an ANGPTL3-associated disease, in combination with other pharmaceuticals and/or other therapeutic methods, e.g., with known pharmaceuticals and/or known therapeutic methods, such as, for example, those which are currently employed for treating these disorders.

Accordingly, in some aspects of the invention, the methods which include either a single iRNA agent of the invention, further include administering to the subject one or more additional therapeutic agents.

For example, in certain embodiments, an iRNA targeting ANGPTL3 is administered in combination with, e.g., an agent useful in treating a disorder of lipid metabolism. For example, additional agents suitable for treating a subject that would benefit from reducton in ANGPTL3 expression, e.g., a subject having a disorder of lipid metabolism, may include agents that lower one or more serum lipids. Non-limiting examples of such agents may include cholesterol synthesis inhibitors, such as HMG-CoA reductase inhibitors, e.g., statins. Statins may include atorvastatin (Lipitor), fluvastatin (Lescol), lovastatin (Mevacor), lovastatin extended-release (Altoprev), pitavastatin (Livalo), pravastatin (Pravachol), rosuvastatin (Crestor), and simvastatin (Zocor). Other agents useful in treating a disorder of lipid metabolism may include bile sequestering agents, such as cholestyramine and other resins; VLDL secretion inhibitors, such as niacin; lipophilic antioxidants, such as Probucol; acyl-CoA cholesterol acyl transferase inhibitors; farnesoid X receptor antagonists; sterol regulatory binding protein cleavage activating protein (SCAP) activators; microsomal triglyceride transfer protein (MTP) inhibitors; ApoE-related peptide; and therapeutic antibodies against ANGPTL3. The additional therapeutic agents may also include agents that raise high density lipoprotein (HDL), such as cholesteryl ester transfer protein (CETP) inhibitors. Furthermore, the additional therapeutic agents may also include dietary supplements, e.g., fish oil. The iRNA and additional therapeutic agents may be administered at the same time and/or in the same combination, e.g., parenterally, or the additional therapeutic agent can be administered as part of a separate composition or at separate times and/or by another method known in the art or described herein.

The iRNA agent and an additional therapeutic agent and/or treatment may be administered at the same time and/or in the same combination, e.g., parenterally, or the additional therapeutic agent can be administered as part of a separate composition or at separate times and/or by another method known in the art or described herein.

VIII. Kits

In certain aspects, the instant disclosure provides kits that include a suitable container containing a pharmaceutical formulation of a siRNA compound, e.g., a double-stranded siRNA compound, or siRNA compound, (e.g., a precursor, e.g., a larger siRNA compound which can be processed into a siRNA compound, or a DNA which encodes an siRNA compound, e.g., a double-stranded siRNA compound, or ssiRNA compound, or precursor thereof).

Such kits include one or more dsRNA agent(s) and instructions for use, e.g., instructions for administering a prophylactically or therapeutically effective amount of a dsRNA agent(s). The dsRNA agent may be in a vial or a pre-filled syringe. The kits may optionally further comprise means for administering the dsRNA agent (e.g., an injection device, such as a pre-filled syringe), or means for measuring the inhibition of ANGPTL3 (e.g., means for measuring the inhibition of ANGPTL3 mRNA, ANGPTL3 protein, and/or ANGPTL3 activity). Such means for measuring the inhibition of ANGPTL3 may comprise a means for obtaining a sample from a subject, such as, e.g., a plasma sample. The kits of the invention may optionally further comprise means for determining the therapeutically effective or prophylactically effective amount.

In certain embodiments the individual components of the pharmaceutical formulation may be provided in one container, e.g., a vial or a pre-filled syringe. Alternatively, it may be desirable to provide the components of the pharmaceutical formulation separately in two or more containers, e.g., one container for a siRNA compound preparation, and at least another for a carrier compound. The kit may be packaged in a number of different configurations such as one or more containers in a single box. The different components can be combined, e.g., according to instructions provided with the kit. The components can be combined according to a method described herein, e.g., to prepare and administer a pharmaceutical composition. The kit can also include a delivery device.

This invention is further illustrated by the following examples which should not be construed as limiting. The entire contents of all references, patents and published patent applications cited throughout this application, as well as the informal Sequence Listing and Figures, are hereby incorporated herein by reference.

EXAMPLES

Example 1. iRNA Synthesis

Source of Reagents

Where the source of a reagent is not specifically given herein, such reagent can be obtained from any supplier of reagents for molecular biology at a quality/purity standard for application in molecular biology.

siRNA Design siRNAs targeting the human Angiopoietin-like 3 (ANGPTL3) gene (human: NCBI refseqID NM_014995.3 and NM_014995.2, NCBI GeneID: 27329) were designed using custom R and Python scripts. The human NM_014995.3 REFSEQ mRNA, has a length of 2951 bases. The human NM_014995.2 REFSEQ mRNA, has a length of 2126 bases.

Detailed lists of the unmodified ANGPTL3 sense and antisense strand nucleotide sequences are shown in Table 2. Detailed lists of the modified ANGPTL3 sense and antisense strand nucleotide sequences are shown in Table 3.

It is to be understood that, throughout the application, a duplex name without a decimal is equivalent to a duplex name with a decimal which merely references the batch number of the duplex. For example, AD-959917 is equivalent to AD-959917.1.

siRNA Synthesis siRNAs were designed, synthesized, and prepared using methods known in the art.

Briefly, siRNA sequences were synthesized on a 1 μmol scale using a Mermade 192 synthesizer (BioAutomation) with phosphoramidite chemistry on solid supports. The solid support was controlled pore glass (500-1000 Å) loaded with a custom GalNAc ligand (3'-GalNAc conjugates), universal solid support (AM Chemicals), or the first nucleotide of interest. Ancillary synthesis reagents and standard 2-cyanoethyl phosphoramidite monomers (2'-deoxy-2'-fluoro, 2'-O- methyl, RNA, DNA) were obtained from Thermo-Fisher (Milwaukee, WI), Hongene (China), or Chemgenes (Wilmington, MA, USA). Additional phosphoramidite monomers were procured from commercial suppliers, prepared in-house, or procured using custom synthesis from various CMOs. Phosphoramidites were prepared at a concentration of 100 mM in either acetonitrile or 9:1 acetonitrile:DMF and were coupled using 5-Ethylthio-1H-tetrazole (ETT, 0.25 M in acetonitrile) with a reaction time of 400 s. Phosphorothioate linkages were generated using a 100 mM solution of 3-((Dimethylamino-methylidene) amino)-3H-1,2,4-dithiazole-3-thione (DDTT, obtained from Chemgenes (Wilmington, MA, USA)) in anhydrous acetonitrile/pyridine (9:1 v/v). Oxidation time was 5 minutes. All sequences were synthesized with final removal of the DMT group ("DMT-Off").

Upon completion of the solid phase synthesis, solid-supported oligoribonucleotides were treated with 300 µL of Methylamine (40% aqueous) at room temperature in 96 well plates for approximately 2 hours to afford cleavage from the solid support and subsequent removal of all additional base-labile protecting groups. For sequences containing any natural ribonucleotide linkages (2'-OH) protected with a tert-butyl dimethyl silyl (TBDMS) group, a second deprotection step was performed using TEA.3HF (triethylamine trihydrofluoride). To each oligonucleotide solution in aqueous methylamine was added 200 µL of dimethyl sulfoxide (DMSO) and 300 µL TEA.3HF and the solution was incubated for approximately 30 mins at 60° C. After incubation, the plate was allowed to come to room temperature and crude oligonucleotides were precipitated by the addition of 1 mL of 9:1 acetonitrile:ethanol or 1:1 ethanol:isopropanol. The plates were then centrifuged at 4° C. for 45 mins and the supernatant carefully decanted with the aid of a multichannel pipette. The oligonucleotide pellet was resuspended in 20 mM NaOAc and subsequently desalted using a HiTrap size exclusion column (5 mL, GE Healthcare) on an Agilent LC system equipped with an autosampler, UV detector, conductivity meter, and fraction collector. Desalted samples were collected in 96 well plates and then analyzed by LC-MS and UV spectrometry to confirm identity and quantify the amount of material, respectively.

Duplexing of single strands was performed on a Tecan liquid handling robot. Sense and antisense single strands were combined in an equimolar ratio to a final concentration of 10 µM in 1×PBS in 96 well plates, the plate sealed, incubated at 100° C. for 10 minutes, and subsequently allowed to return slowly to room temperature over a period of 2-3 hours. The concentration and identity of each duplex was confirmed and then subsequently utilized for in vitro screening assays.

Example 2. In Vitro Screening Methods

Cell Culture and 384-Well Transfections

For transfections, primary cynomolgus hepatocytes (PCH) cells or Hep3B cells (ATCC, Manassas, VA) were grown to near confluence at 37° C. in an atmosphere of 5% $CO_2$ in Eagle's Minimum Essential Medium (Gibco) supplemented with 10% FBS (ATCC) before being released from the plate by trypsinization. Transfection was carried out by adding 7.5 µl of Opti-MEM plus 0.1 µl of Lipofectamine RNAiMax per well (Invitrogen, Carlsbad CA. cat #13778-150) to 2.5 µl of each siRNA duplex to an individual well in a 384-well plate. The mixture was then incubated at room temperature for 15 minutes. Forty µl of complete growth media without antibiotic containing ~$1.5 \times 10^4$ cells were then added to the siRNA mixture. Cells were incubated for 24 hours prior to RNA purification. Single dose experiments were performed at 10 nM, 1 nM, and 0.1 nM final duplex concentration.

Total RNA Isolation Using DYNABEADS mRNA Isolation Kit (Invitrogen™, Part #: 610-12)

Cells were lysed in 75 µl of Lysis/Binding Buffer containing 3 µL of beads per well and mixed for 10 minutes on an electrostatic shaker. The washing steps were automated on a Biotek EL406, using a magnetic plate support. Beads were washed (in 90 µL) once in Buffer A, once in Buffer B, and twice in Buffer E, with aspiration steps in between. Following a final aspiration, complete 10 µL RT mixture was added to each well, as described below.

cDNA Synthesis Using ABI High Capacity cDNA Reverse Transcription Kit (Applied Biosystems, Foster City, CA, Cat #4368813)

A master mix of 1 µl 10× Buffer, 0.4 µl 25×dNTPs, 1 µl Random primers, 0.5 µl Reverse Transcriptase, 0.5 µl RNase inhibitor and 6.6 µl of $H_2O$ per reaction were added per well. Plates were sealed, agitated for 10 minutes on an electrostatic shaker, and then incubated at 37 degrees C. for 2 hours. Following this, the plates were agitated at 80 degrees C. for 8 minutes.

Real Time PCR

Two microlitre (µl) of cDNA were added to a master mix containing 0.5 µl of human GAPDH TaqMan Probe (4326317E), 0.5 µl human ANGPTL3, 2 µl nuclease-free water and 5 µl Lightcycler 480 probe master mix (Roche Cat #04887301001) per well in a 384 well plates (Roche cat #04887301001). Real time PCR was done in a LightCycler480 Real Time PCR system (Roche).

To calculate relative fold change, data were analyzed using the ΔΔCt method and normalized to assays performed with cells transfected with 10 nM AD-1955, or mock transfected cells. $IC_{50}$s were calculated using a 4 parameter fit model using XLFit and normalized to cells transfected with AD-1955 or mock-transfected. The sense and antisense sequences of AD-1955 are: sense: cuuAcGcuGAGuAcuucGAdTsdT (SEQ ID NO: 27) and antisense UCGAAGuACUcAGCGuAAGdTsdT (SEQ ID NO: 28).

The results of the single dose screens of the dsRNA agents listed in Tables 2 and 3 in primary cynomolgus hepatocytes (PCH) are shown in Table 4.

TABLE 1

Abbreviations of nucleotide monomers used in nucleic acid sequence representation. It will be understood that these monomers, when present in an oligonucleotide, are mutually linked by 5'-3'-phosphodiester bonds; and it is understood that when the nucleotide contains a 2'-fluoro modification, then the fluoro replaces the hydroxy at that position in the parent nucleotide (i.e., it is a 2'-deoxy-2'-fluoronucleotide).

| Abbreviation | Nucleotide(s) |
| --- | --- |
| A | Adenosine-3'-phosphate |
| Ab | beta-L-adenosine-3'-phosphate |

TABLE 1-continued

Abbreviations of nucleotide monomers used in nucleic acid sequence representation. It will be understood that these monomers, when present in an oligonucleotide, are mutually linked by 5'-3'-phosphodiester bonds; and it is understood that when the nucleotide contains a 2'-fluoro modification, then the fluoro replaces the hydroxy at that position in the parent nucleotide (i.e., it is a 2'-deoxy-2'-fluoronucleotide).

| Abbreviation | Nucleotide(s) |
|---|---|
| Abs | beta-L-adenosine-3'-phosphorothioate |
| Af | 2'-fluoroadenosine-3'-phosphate |
| Afs | 2'-fluoroadenosine-3'-phosphorothioate |
| As | adenosine-3'-phosphorothioate |
| C | cytidine-3'-phosphate |
| Cb | beta-L-cytidine-3'-phosphate |
| Cbs | beta-L-cytidine-3'-phosphorothioate |
| Cf | 2'-fluorocytidine-3'-phosphate |
| Cfs | 2'-fluorocytidine-3'-phosphorothioate |
| Cs | cytidine-3'-phosphorothioate |
| G | guanosine-3'-phosphate |
| Gb | beta-L-guanosine-3'-phosphate |
| Gbs | beta-L-guanosine-3'-phosphorothioate |
| Gf | 2'-fluoroguanosine-3'-phosphate |
| Gfs | 2'-fluoroguanosine-3'-phosphorothioate |
| Gs | guanosine-3'-phosphorothioate |
| T | 5'-methyluridine-3'-phosphate |
| Tf | 2'-fluoro-5-methyluridine-3'-phosphate |
| Tfs | 2'-fluoro-5-methyluridine-3'-phosphorothioate |
| Ts | 5-methyluridine-3'-phosphorothioate |
| U | Uridine-3'-phosphate |
| Uf | 2'-fluorouridine-3'-phosphate |
| Ufs | 2'-fluorouridine-3'-phosphorothioate |
| Us | uridine-3'-phosphorothioate |
| N | any nucleotide, modified or unmodified |
| a | 2'-O-methyladenosine-3'-phosphate |
| as | 2'-O-methyladenosine-3'-phosphorothioate |
| c | 2'-O-methylcytidine-3'-phosphate |
| cs | 2'-O-methylcytidine-3'-phosphorothioate |
| g | 2'-O-methylguanosine-3'-phosphate |
| gs | 2'-O-methylguanosine-3'-phosphorothioate |
| t | 2'-O-methyl-5-methyluridine-3'-phosphate |
| ts | 2'-O-methyl-5-methyluridine-3'-phosphorothioate |
| u | 2'-O-methyluridine-3'-phosphate |
| us | 2'-O-methyluridine-3'-phosphorothioate |
| s | phosphorothioate linkage |
| L10 | N-(cholesterylcarboxamidocaproyl)-4-hydroxyprolinol (Hyp-C6-Chol) |
| L96 | N-[tris(GalNAc-alkyl)-amidodecanoyl)]-4-hydroxyprolinol (Hyp-(GalNAc-alkyl)3) |

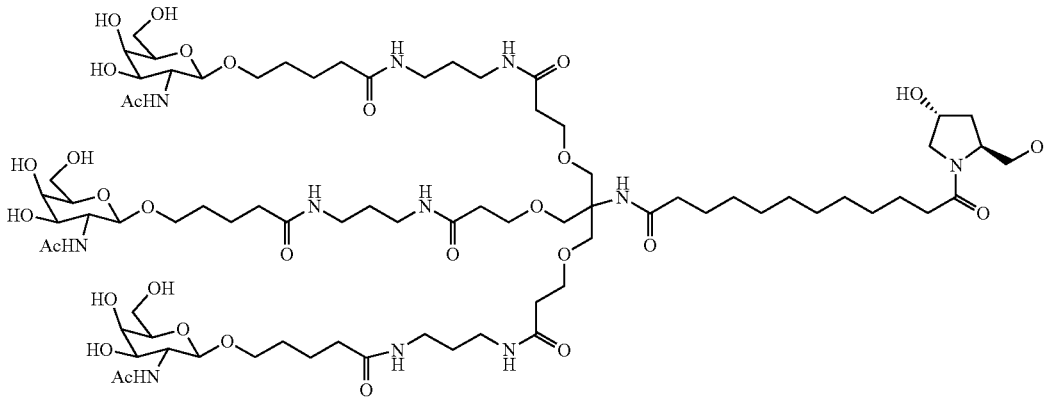

| | |
|---|---|
| Y34 | 2-hydroxymethyl-tetrahydrofurane-4-methoxy-3-phosphate (abasic 2'-OMe furanose) |
| Y44 | inverted abasic DNA (2-hydroxymethyl-tetrahydrofurane-5-phosphate) |
| (Agn) | Adenosine-glycol nucleic acid (GNA) S-Isomer |
| (Cgn) | Cytidine-glycol nucleic acid (GNA) S-Isomer |
| (Ggn) | Guanosine-glycol nucleic acid (GNA) S-Isomer |
| (Tgn) | Thymidine-glycol nucleic acid (GNA) S-Isomer |
| P | Phosphate |
| VP | Vinyl-phosphonate |
| dA | 2'-deoxyadenosine-3'-phosphate |
| dAs | 2'-deoxyadenosine-3'-phosphorothioate |
| dC | 2'-deoxycytidine-3'-phosphate |
| dCs | 2'-deoxycytidine-3'-phosphorothioate |
| dG | 2'-deoxyguanosine-3'-phosphate |
| dGs | 2'-deoxyguanosine-3'-phosphorothioate |

TABLE 1-continued

Abbreviations of nucleotide monomers used in nucleic acid sequence representation. It will be understood that these monomers, when present in an oligonucleotide, are mutually linked by 5'-3'-phosphodiester bonds; and it is understood that when the nucleotide contains a 2'-fluoro modification, then the fluoro replaces the hydroxy at that position in the parent nucleotide (i.e., it is a 2'-deoxy-2'-fluoronucleotide).

| Abbreviation | Nucleotide(s) |
|---|---|
| dT | 2'-deoxythimidine-3'-phosphate |
| dTs | 2'-deoxythimidine-3'-phosphorothioate |
| dU | 2'-deoxyuridine |
| dUs | 2'-deoxyuridine-3'-phosphorothioate |
| (C2p) | cytidine-2'-phosphate |
| (G2p) | guanosine-2'-phosphate |
| (U2p) | uridine-2'-phosphate |
| (A2p) | adenosine-2'-phosphate |
| (Chd) | 2'-O-hexadecyl-cytidine-3'-phosphate |
| (Ahd) | 2'-O-hexadecyl-adenosine-3'-phosphate |
| (Ghd) | 2'-O-hexadecyl-guanosine-3'-phosphate |
| (Uhd) | 2'-O-hexadecyl-uridine-3'-phosphate |
| s | phosphorothioate |

TABLE 2

Unmodified Sense and Antisense Strand Sequences of ANGPTL3 dsRNA Agents

| Duplex Name | Sense Sequence 5' to 3' | SEQ ID NO: | Source Name | Range in NM_014495.3 | Antisense Sequence 5' to 3' | SEQ ID NO: | Source Name | Range in NM_014495.3 |
|---|---|---|---|---|---|---|---|---|
| AD-1331197.1 | AUAAAAAUGUUCACAAUUAAU | 29 | NM_014495.3_75-95_G21U_s | 75-95 | AUUAAUUGUGAACAUUUUAUCU | 138 | | 73-95 |
| AD-1331198.1 | UAAAAAUGUUCACAAUUAAGU | 30 | NM_014495.3_76-96_C21U_s | 76-96 | ACUUAAUUGUGAACAUUUUUAUC | 139 | | 74-96 |
| AD-1331199.1 | AAAAAUGUUCACAAUUAAGCU | 31 | NM_014495.3_77-97_s | 77-97 | AGCUUAAUUGUGAACAUUUUUAU | 140 | | 75-97 |
| AD-1331200.1 | AAAAUGUUCACAAUUAAGCUU | 32 | NM_014495.3_78-98_C21U_s | 78-98 | AAGCUUAAUUGUGAACAUUUUUA | 141 | | 76-98 |
| AD-1331201.1 | AAAUGUUCACAAUUAAGCUCU | 33 | NM_014495.3_79-99_C21U_s | 79-99 | AGAGCUUAAUUGUGAACAUUUU | 142 | | 77-99 |
| AD-1331202.1 | AUGUUCACAAUUAAGCUCCUU | 34 | NM_014495.3_81-101_s | 81-101 | AAGGAGCUUAAUUGUGAACAUUU | 143 | | 79-101 |
| AD-1331203.1 | UGUUCACAAUUAAGCUCCUUU | 35 | NM_014495.3_82-102_C21U_s | 82-102 | AAAGGAGCUUAAUUGUGAACAUU | 144 | | 80-102 |
| AD-1331204.1 | GUUCACAAUUAAGCUCCUUCU | 36 | NM_014495.3_83-103_s | 83-103 | AGAAGGAGCUUAAUUGUGAACAU | 145 | | 81-103 |
| AD-1331205.1 | UUCACAAUUAAGCUCCUUCUU | 37 | NM_014495.3_84-104_s | 84-104 | AAGAAGGAGCUUAAUUGUGAACA | 146 | | 82-104 |
| AD-66977.2 | UCACAAUUAAGCUCCUUCUUU | 38 | | 85-105 | AAAGAAGGAGCUUAAUUGUGAAC | 147 | NM_014495.2_54-76_as | 83-105 |
| AD-1331206.1 | CACAAUUAAGCUCCUUCUUUU | 39 | NM_014495.3_86-106_s | 86-106 | AAAAGAAGGAGCUUAAUUGUGAA | 148 | | 84-106 |
| AD-1331207.1 | ACAAUUAAGCUCCUUCUUUUU | 40 | NM_014495.3_87-107_s | 87-107 | AAAAAGAAGGAGCUUAAUUGUGA | 149 | | 85-107 |
| AD-1331208.1 | CAAUUAAGCUCCUUCUUUUUU | 41 | NM_014495.3_88-108_s | 88-108 | AAAAAAGAAGGAGCUUAAUUGUG | 150 | | 86-108 |
| AD-1331209.1 | AAUUAAGCUCCUUCUUUUUAU | 42 | NM_014495.3_89-109_s | 89-109 | AUAAAAAGAAGGAGCUUAAUUGU | 151 | | 87-109 |
| AD-67003.3 | AUUAAGCUCCUUCUUUUUAUU | 43 | | 90-110 | AAUAAAAAGAAGGAGCUUAAUUG | 152 | NM_014495.2_59-81_as | 88-110 |
| AD-1331210.1 | UUAAGCUCCUUCUUUUUAUUU | 44 | NM_014495.3_91-111_G21U_s | 91-111 | AAAUAAAAAGAAGGAGCUUAAUU | 153 | | 89-111 |

TABLE 2-continued

Unmodified Sense and Antisense Strand Sequences of ANGPTL3 dsRNA Agents

| Duplex Name | Sense Sequence 5' to 3' | SEQ ID NO: | Source Name | Range in NM_014495.3 | Antisense Sequence 5' to 3' | SEQ ID NO: | Source Name | Range in NM_014495.3 |
|---|---|---|---|---|---|---|---|---|
| AD-1331211.1 | UAAGCUCCUUCUUUUUAUUGU | 45 | NM_014495.3_92-112_s | 92-112 | ACAAUAAAAAGAAGGAGCUUAAU | 154 | | 90-112 |
| AD-1331212.1 | AAGCUCCUUCUUUUUAUUGUU | 46 | NM_014495.3_93-113_s | 93-113 | AACAUAAAAAGAAGGAGCUUAA | 155 | | 91-113 |
| AD-1331213.1 | AGCUCCUUCUUUUUAUUGUUU | 47 | | 94-114 | AAACAUAAAAAGAAGGAGCUUA | 156 | | 92-114 |
| AD-1331214.1 | GCUCCUUCUUUUUAUUGUUUU | 48 | | 95-115 | AGAACAUAAAAAGAAGGAGCUU | 157 | | 93-115 |
| AD-1331215.1 | CUCCUUCUUUUUAUUGUUCCU | 49 | NM_014495.3_96-116_s | 96-116 | AGGAACAUAAAAAGAAGGAGCU | 158 | | 94-116 |
| AD-1331216.1 | UCCUUCUUUUUAUUGUUCCUU | 50 | | 97-117 | AAGGAACAUAAAAAGAAGGAGC | 159 | | 95-117 |
| AD-1331217.1 | CCUUCUUUUUAUUGUUCCUUC | 51 | | 98-118 | AGAGGAACAUAAAAAGAAGGAG | 160 | | 96-118 |
| AD-1331218.1 | CUUCUUUUUAUUGUUCCUUCU | 52 | | 99-119 | UAGAGGAACAUAAAAAGAAGGA | 161 | | 97-119 |
| AD-1331220.1 | UCUUUUUAUUGUUCCUUCUAGU | 53 | NM_014495.3_101-121_s | 101-121 | ACUAGAGGAACAUAAAAAGAAG | 162 | | 99-121 |
| AD-1331221.1 | CUUUUUAUUGUUCCUUCUAGUU | 54 | NM_014495.3_102-122_s | 102-122 | AACUAGAGGAACAUAAAAAGAA | 163 | | 100-122 |
| AD-1331222.1 | UUUUUAUUGUUCCUUCUAGUUU | 55 | | 103-123 | AAACUAGAGGAACAUAAAAAGA | 164 | | 101-123 |
| AD-1331223.1 | UUUUAUUGUUCCUUCUAGUUAU | 56 | NM_014495.3_104-124_s | 104-124 | AUAACUAGAGGAACAUAAAAAG | 165 | | 102-124 |
| AD-1331224.1 | AUUUCAAAAACUCAACAUAUU | 57 | NM_014495.3_293-313_s | 293-313 | AAUAUGUUGAGUUUUUGAAAUU | 166 | | 291-313 |
| AD-1331225.1 | UUUCAAAAACUCAACAUAUUU | 58 | NM_014495.3_294-314_s | 294-314 | AAAUAUGUUGAGUUUUUGAAAUA | 167 | | 292-314 |
| AD-1331226.1 | UUCAAAAACUCAACAUAUUUG | 59 | | 295-315 | AAAAUAUGUUGAGUUUUUGAAU | 168 | | 293-315 |
| AD-1331227.1 | UCAAAAACUCAACAUAUUUGU | 60 | | 296-316 | ACAAAUAUGUUGAGUUUUUGAAA | 169 | | 294-316 |
| AD-1331228.1 | CAAAAACUCAACAUAUUUGAU | 61 | NM_014495.3_297-317_s | 297-317 | AUCAAAUAUGUUGAGUUUUUGAA | 170 | | 295-317 |
| AD-1331229.1 | AAAAACUCAACAUAUUUGAUU | 62 | NM_014495.3_298-318_C21U_s | 298-318 | AAUCAAAUAUGUUGAGUUUUUGA | 171 | | 296-318 |
| AD-1331230.1 | AAAACUCACAUAUUUGAUCU | 63 | | 299-319 | AGAUCAAAUAUGAGUUUUUG | 172 | | 297-319 |

TABLE 2 -continued

Unmodified Sense and Antisense Strand Sequences of ANGPTL3 dsRNA Agents

| Duplex Name | Sense Sequence 5' to 3' | SEQ ID NO: | Source Name | Range in NM_014495.3 | Antisense Sequence 5' to 3' | SEQ ID NO: | Source Name | Range in NM_014495.3 |
|---|---|---|---|---|---|---|---|---|
| AD-1331231.1 | AAACUCAACAUAUUUGAUCAU | 64 | NM_014495.3_300-320_G21U_s | 300-320 | AUGAUCAAAUAUGUUGAGUUUU | 173 | | 298-320 |
| AD-1331232.1 | AACUCAACAUAUUGAUCAGU | 65 | NM_014495.3_301-321_s | 301-321 | ACUGAUCAAAUAUGUUGAGUUU | 174 | | 299-321 |
| AD-1331233.1 | ACUCAACAUAUUUGAUCAGUU | 66 | NM_014495.3_302-322_C21U_s | 302-322 | AACUGAUCAAAUAUGUUGAGUU | 175 | | 300-322 |
| AD-1331234.1 | UCAACAUAUUUGAUCAGUCUU | 67 | NM_014495.3_304-324_s | 304-324 | AAGACUGAUCAAAUAUGUUGAGU | 176 | | 302-324 |
| AD-67031.2 | CAACAUAUUUGAUCAGUCUUU | 68 | | 305-325 | AAAGACUGAUCAAAUAUGUUGAG | 177 | NM_014495.2_274-296_as | 303-325 |
| AD-1331235.1 | AACAUAUUUGAUCAGUCUUUU | 69 | NM_014495.3_306-326_s | 306-326 | AAAAGACUGAUCAAAUAUGUUGA | 178 | | 304-326 |
| AD-65695.22 | ACAUAUUUGAUCAGUCUUUUU | 70 | | 307-327 | AAAAAGACUGAUCAAAUAUGUUG | 179 | NM_014495.2_276-298_as | 305-327 |
| AD-1331236.1 | CAUAUUUGAUCAGUCUUUUUU | 71 | | 308-328 | AAAAAAGACUGAUCAAAUAUGUU | 180 | | 306-328 |
| AD-1331237.1 | AUAUUUGAUCAGUCUUUUUAU | 72 | NM_014495.3_309-329_s | 309-329 | AUAAAAAGACUGAUCAAAUAUGU | 181 | | 307-329 |
| AD-1331238.1 | UAUUUGAUCAGUCUUUUUAUU | 73 | NM_014495.3_310-330_G21U_s | 310-330 | AAUAAAAAGACUGAUCAAAUAUG | 182 | | 308-330 |
| AD-1331239.1 | AUUUGAUCAGUCUUUUUAUGU | 74 | | 311-331 | ACAUAAAAAGACUGAUCAAAUAU | 183 | | 309-331 |
| AD-1331240.1 | UUUGAUCAGUCUUUUUAUGAU | 75 | NM_014495.3_312-332_s | 312-332 | AUCAUAAAAAGACUGAUCAAAUA | 184 | | 310-332 |
| AD-1331241.1 | UUGAUCAGUCUUUUUAUGAUU | 76 | NM_014495.3_313-333_s | 313-333 | AAUCAUAAAAAGACUGAUCAAAU | 185 | | 311-333 |
| AD-1331242.1 | UGAUCAGUCUUUUUAUGAUCU | 77 | NM_014495.3_314-334_s | 314-334 | AGAUCAUAAAAAGACUGAUCAA | 186 | | 312-334 |
| AD-1331243.1 | GAUCAGUCUUUUUAUGAUCUA | 78 | NM_014495.3_315-335_s | 315-335 | UAGAUCAUAAAAAGACUGAUCAA | 187 | | 313-335 |
| AD-1331244.1 | AUCAGUCUUUUUAUGAUCUAU | 79 | NM_014495.3_316-336_s | 316-336 | AUAGAUCAUAAAAAGACUGAUCA | 188 | | 314-336 |
| AD-1331245.1 | UCAGUCUUUUUAUGAUCUAUU | 80 | NM_014495.3_317-337_C21U_s | 317-337 | AAUAGAUCAUAAAAAGACUGAUC | 189 | | 315-337 |

TABLE 2-continued

Unmodified Sense and Antisense Strand Sequences of ANGPTL3 dsRNA Agents

| Duplex Name | Sense Sequence 5' to 3' | SEQ ID NO: | Source Name | Range in NM_014495.3 | Antisense Sequence 5' to 3' | SEQ ID NO: | Source Name | Range in NM_014495.3 |
|---|---|---|---|---|---|---|---|---|
| AD-1331246.1 | CAGUCUUUUAUGAUCUAUCU | 81 | NM_014495.3_318-338_G21U_s | 318-338 | AGAUAGAUCAUAAAAGACUGAU | 190 | | 316-338 |
| AD-1331247.1 | AGUCUUUUAUGAUCUAUCGU | 82 | NM_014495.3_319-339_C21U_s | 319-339 | ACGAUAGAUCAUAAAAGACUGA | 191 | | 317-339 |
| AD-1331248.1 | GUCUUUUAUGAUCUAUCGCU | 83 | NM_014495.3_320-340_s | 320-340 | AGCGAUAGAUCAUAAAAGACUG | 192 | | 318-340 |
| AD-1331249.1 | UCUUUUAUGAUCUAUCGCUU | 84 | NM_014495.3_321-341_G21U_s | 321-341 | AAGCGAUAGAUCAUAAAAGACU | 193 | | 319-341 |
| AD-1331250.1 | CUUUUAUGAUCUAUCGCUGU | 85 | NM_014495.3_322-342_C21U_s | 322-342 | ACAGCGAUAGAUCAUAAAAGAC | 194 | | 320-342 |
| AD-1331251.1 | AACUCCAGAACACCCAGAAGU | 86 | NM_014495.3_542-562_s | 542-562 | ACUUCUGGGUGUUCUGGAGUUC | 195 | | 540-562 |
| AD-1331252.1 | ACUCCAGAACACCCAGAAGUA | 87 | NM_014495.3_543-563_s | 543-563 | UACUCUGGGUGUUCUGGAGUUU | 196 | | 541-563 |
| AD-1331253.1 | CUCCAGAACACCCAGAAGUAA | 88 | NM_014495.3_544-564_s | 544-564 | UUACUUCUGGGUGUUCUGGAGUU | 197 | | 542-564 |
| AD-1331254.1 | UCCAGAACACCCAGAAGUAAU | 89 | NM_014495.3_545-565_C21U_s | 545-565 | AUUACUUCUGGGUGUUCUGGAGU | 198 | | 543-565 |
| AD-1331255.1 | CCAGAACACCCAGAAGUAACU | 90 | NM_014495.3_546-566_s | 546-566 | AGUUACUUCUGGGUGUUCUGGAG | 199 | | 544-566 |
| AD-1331256.1 | CAGAACACCCAGAAGUAACUU | 91 | NM_014495.3_547-567_s | 547-567 | AAGUUACUUCUGGGUGUUCUGGA | 200 | | 545-567 |
| AD-1331257.1 | AGAACACCCAGAAGUAACUUU | 92 | NM_014495.3_548-568_C21U_s | 548-568 | AAAGUUACUUCUGGGUGUUCUGG | 201 | | 546-568 |
| AD-1331258.1 | GAACACCCAGAAGUAACUUCA | 93 | NM_014495.3_549-569_s | 549-569 | UGAAGUUACUUCUGGGUGUUCUG | 202 | | 547-569 |
| AD-1331259.1 | AACACCCAGAAGUAACUUCAU | 94 | NM_014495.3_550-570_C21U_s | 550-570 | AUGAAGUUACUUCUGGGUGUUCU | 203 | | 548-570 |
| AD-1331260.1 | ACACCCAGAAGUAACUUCACU | 95 | NM_014495.3_551-571_s | 551-571 | AGUGAAGUUACUUCUGGGUGUUC | 204 | | 549-571 |
| AD-1331261.1 | CACCCAGAAGUAACUUCACUU | 96 | NM_014495.3_552-572_s | 552-572 | AAGUGAAGUUACUUCUGGGUGUU | 205 | | 550-572 |

TABLE 2 -continued

Unmodified Sense and Antisense Strand Sequences of ANGPTL3 dsRNA Agents

| Duplex Name | Sense Sequence 5' to 3' | SEQ ID NO: | Source Name | Range in NM_014495.3 | Antisense Sequence 5' to 3' | SEQ ID NO: | Source Name | Range in NM_014495.3 |
|---|---|---|---|---|---|---|---|---|
| AD-1331262.1 | ACCCAGAAGUAACUUCACUUU | 97 | | | AAAGUGAAGUUACUUCUGGGUGU | 206 | | 551-573 |
| AD-1331263.1 | CCCAGAAGUAACUUCACUUAA | 98 | NM_014495.3_554-574_s | 553-573 | UUAAGUGAAGUUACUUCUGGGUG | 207 | | 552-574 |
| AD-1331264.1 | CCAGAAGUAACUUCACUUAAA | 99 | NM_014495.3_557-576_s | 554-574 | UUUAAGUGAAGUUACUUCUGGGU | 208 | | 553-575 |
| AD-1331265.1 | CAGAAGUAACUUCACUUAAAA | 100 | NM_014495.3_556-576_s | 555-575 | UUUUAAGUGAAGUUACUUCUGGG | 209 | | 554-576 |
| AD-1331266.1 | AGAAGUAACUUCACUUAAAAU | 101 | NM_014495.3_557-577_C21U_s | 556-576 | AUUUUAAGUGAAGUUACUUCUGG | 210 | | 555-577 |
| AD-1331267.1 | GAAGUAACUUCACUUAAAACU | 102 | NM_014495.3_558-578_s | 557-577 | AGUUUUAAGUGAAGUUACUUCUG | 211 | | 556-578 |
| AD-1331268.1 | AAGUAACUUCACUUAAAACUU | 103 | NM_014495.3_559-579_s | 558-578 | AAGUUUUAAGUGAAGUUACUUCU | 212 | | 557-579 |
| AD-1331269.1 | AGUAACUUCACUUAAAACUUU | 104 | NM_014495.3_560-580_s | 559-579 | AAAGUUUUAAGUGAAGUUACUUC | 213 | | 558-580 |
| AD-1331270.1 | GUAACUUCACUUAAAACUUUU | 105 | NM_014495.3_561-581_s | 560-580 | AAAAGUUUUAAGUGAAGUUACUU | 214 | | 559-581 |
| AD-1331271.1 | UAACUUCACUUAAAACUUUUU | 106 | | 561-581 | AAAAAGUUUUAAGUGAAGUUACU | 215 | | 560-582 |
| AD-1331272.1 | AACUUCACUUAAAACUUUUGU | 107 | NM_014495.3_563-583_s | 562-582 | ACAAAAGUUUUAAGUGAAGUUAC | 216 | | 561-583 |
| AD-1331273.1 | ACUUCACUUAAAACUUUUGUU | 108 | | 563-583 | AACAAAAGUUUUAAGUGAAGUUA | 217 | | 562-584 |
| AD-1331274.1 | CUUCACUUAAAACUUUUGUAU | 109 | NM_014495.3_565-585_G21U_s | 564-584 | AUACAAAAGUUUUAAGUGAAGUU | 218 | | 563-585 |
| AD-1331275.1 | UUCACUUAAAACUUUUGUAGU | 110 | | 565-585 | ACUACAAAAGUUUUAAGUGAAGU | 219 | | 564-586 |
| AD-1331276.1 | UCACUUAAAACUUUUGUAGAU | 111 | | 566-586 | AUCUACAAAAGUUUUAAGUGAAG | 220 | | 565-587 |
| AD-1331277.1 | CACUUAAAACUUUUGUAGAAA | 112 | NM_014495.3_570-589_s | 567-587 | UUUCUACAAAAGUUUUAAGUGAA | 221 | | 566-588 |
| AD-1331278.1 | ACUUAAAACUUUUGUAGAAAA | 113 | NM_014495.3_569-589_s | 568-588 | UUUUCUACAAAAGUUUUAAGUGA | 222 | | 567-589 |
| AD-1331279.1 | AAUGUUCACAAUUAAGCUCCU | 114 | | 569-589 | AGGAGCUAAUUGUGAACAUUUU | 223 | | 78-100 |

TABLE 2 -continued

Unmodified Sense and Antisense Strand Sequences of ANGPTL3 dsRNA Agents

| Duplex Name | Sense Sequence 5' to 3' | SEQ ID NO: Source Name | Range in NM_014495.3 | Antisense Sequence 5' to 3' | SEQ ID NO: Source Name | Range in NM_014495.3 |
|---|---|---|---|---|---|---|
| AD-1331280.1 | AUUUGCUAUGUUAGACGAUGU | 115 | 188-208 | ACAUCGUCUAACAUAGCAAUCU | 224 | 186-208 |
| AD-1331281.1 | UUGCUAUGUUAGACGAUGUAA | 116 | 190-210 | UUACAUCGUCUAACAUAGCAAA | 225 | 188-210 |
| AD-1331282.1 | UGCUAUGUUAGACGAUGUAAA | 117 | 191-211 | UUUACAUCGUCUAACAUAGCAA | 226 | 189-211 |
| AD-1331283.1 | AACUGAGAAGAACUACACAUA | 118 | 373-393 | UAUAUGUAGUUCUUCUCAGUUCC | 227 | 371-393 |
| AD-1331284.1 | AACCAACAGCAUAGUCAAAUA | 119 | 648-668 | UAUUUGACUAUGCUGUUGGUUA | 228 | 646-668 |
| AD-1331285.1 | CCCACAGAAAUUUCUCUAUCU | 120 | 711-731 | AGAUAGAGAAAUUUCUGUGGGU | 229 | 709-731 |
| AD-1331286.1 | CAGGUAGUCCAUGGACAUUAA | 121 | 913-933 | UUAAUGUCCAUGGACUACCUGAU | 230 | 911-933 |
| AD-1331287.1 | GGUAGUCCAUGGACAUUAAUU | 122 | 915-935 | AAUUAAUGUCCAUGGACUACCUG | 231 | 913-935 |
| AD-1331288.1 | AGUUGGAAGACUGGAAAGACA | 123 | 1081-1101 | UGUCUUUCCAGTCUUCCUUCCAACUCA | 232 | 1079-1101 |
| AD-1331289.1 | UGGAAAGACAACAAACAUUAU | 124 | 1092-1112 | ATAAUGUUUGUUGUCUUUCCAGU | 233 | 1090-1112 |
| AD-1331290.1 | UUUACUUGGGAAAUCACGAAA | 125 | 1126-1146 | UUUCGUGAUUUCCCAAGUAAAA | 234 | 1124-1146 |
| AD-1331291.1 | GGGAAAUCACGAAACCACUA | 126 | 1133-1153 | UAGUGGUUUCGUGAUUUCCCAA | 235 | 1131-1153 |
| AD-1331292.1 | GAAAUCACGAAACCACUAUA | 127 | 1135-1155 | UAUAGUGGUUUCGUGAUUUCCC | 236 | 1133-1155 |
| AD-1331293.1 | CGAAACCACUAUACGCUACA | 128 | 1142-1162 | UGUAGCGUAUAGUGGUUUCGUG | 237 | 1140-1162 |
| AD-1331294.1 | AUCAACCAAAAUGUUGAUCCA | 129 | 1415-1435 | UGGAUCAACAUUUGGUUGAUUU | 238 | 1413-1435 |
| AD-1331295.1 | UUAAAACUCUAAACUUGACUA | 130 | 1850-1870 | UAGUCAAGUUUGAGUUUAACA | 239 | 1848-1870 |
| AD-1331296.1 | CAAAACUUGAAAGCCUCCUAU | 131 | 445-465 | ATAGGAGGCUUUCAAGUUUGAG | 240 | 443-465 |
| AD-1331297.1 | UCAACAUCGAAUAGAUGGAUU | 132 | 935-955 | AAUCCAUCUAUUCGAUGUUGAAU | 241 | 933-955 |
| AD-1331298.1 | CAAAACUUCAAUGAAACGUGU | 133 | 957-977 | ACACGUUUCAUUGAAGUUUUGUG | 242 | 955-977 |
| AD-1331299.1 | AAUCAGAAACCAACUAUACU | 134 | 1137-1157 | AGUAUAGUUGGUUUCCUGAUUUC | 243 | 1135-1157 |
| AD-1331300.1 | GGGAAUCAAUUUAGAUGGUU | 135 | 1695-1715 | AACCAUCUAAAAUUGAUUCCCAC | 244 | 1693-1715 |
| AD-1331301.1 | CAAAAUGUGAUCCAUCCAAU | 136 | 1421-1441 | AUUGGAUGGAUCAACAUUUGGU | 245 | 1419-1441 |
| AD-1331302.1 | UGGACAUUAAUUCAACAUCGA | 137 | 924-944 | UCGAUGUUGAAUUAAUGUCCAUG | 246 | 922-944 |
| AD-1331328.1 | AAUGUUCACAAUUAAGCUCCU | 114 | 80-100 | AGGAGCUAAUUGUGAACAUUUU | 247 | 78-100 |

TABLE 2 -continued

Unmodified Sense and Antisense Strand Sequences of ANGPTL3 dsRNA Agents

| Duplex Name | Sense Sequence 5' to 3' | SEQ ID NO: | Source Name | Range in NM_014495.3 | Antisense Sequence 5' to 3' | SEQ ID NO: | Source Name | Range in NM_014495.3 |
|---|---|---|---|---|---|---|---|---|
| AD-1331329.1 | AUUUGCUAUGUUAGACGAUGU | 115 | | 188-208 | ACAUCGUCUAACAUAGCAAAUCU | 248 | | 186-208 |
| AD-1331330.1 | UUGCUAUGUUAGACGAUGUAA | 116 | | 190-210 | UUACAUCGUCUAACAUAGCAAA | 249 | | 188-210 |
| AD-1331306.1 | UGCUAUGUUAGACGAUGUAAA | 117 | | 191-211 | UUUACAUCGUCUAACAUAGCAAA | 226 | | 189-211 |
| AD-1331331.1 | AACUGAGAAGAACUACACAUA | 118 | | 373-393 | UAUAUGUAGUUCUUCUCAGUUCC | 250 | | 371-393 |
| AD-1331332.1 | AACCAACAGCAUAGUCAAAUA | 119 | | 648-668 | UAUUUGACUAUGCUGUUGGUUUA | 251 | | 646-668 |
| AD-1331333.1 | CCCACAGAAAUUUCUCUAUCU | 120 | | 711-731 | AGAUAGAGAAAUUUCUGUGGGUU | 252 | | 709-731 |
| AD-1331334.1 | CAGGUAGUCCAUGGACAUUAA | 121 | | 913-933 | UUAAUGUCCAUGGACUACCUGAU | 253 | | 911-933 |
| AD-1331311.1 | GGUAGUCCAUGGACAUUAAAU | 122 | | 915-935 | AAUUAAUGUCCAUGGACUACCUG | 231 | | 913-935 |
| AD-1331335.1 | AGUUGGAAGACUGGAAAGACA | 123 | | 1081-1101 | UGUCUUUCCAGUCUUCCAACUCA | 254 | | 1079-1101 |
| AD-1331336.1 | UGGAAAGACAACAAACAUUAU | 124 | | 1092-1112 | AUAAUGUUUGUUGUCUUUCCAGU | 255 | | 1090-1112 |
| AD-1331314.1 | UUUACUUGGGAAAUCACCGAA | 125 | | 1126-1146 | UUCGGUGAUUUCCCAAGUAAAAA | 234 | | 1124-1146 |
| AD-1331337.1 | GGGAAAUCACGAAACCACACUA | 126 | | 1133-1153 | UAGUGGUUUCGUGAUUUCCCAA | 256 | | 1131-1153 |
| AD-1331316.1 | GAAAUCACGAAACCACAAACUAUA | 127 | | 1135-1155 | UAUAGUUGGUUUCGUGAUUUCC | 236 | | 1133-1155 |
| AD-1331338.1 | CGAAACCAACUAUACGCUACA | 128 | | 1142-1162 | UGUAGCGUAUAGUUGGUUUCGUG | 257 | | 1140-1162 |
| AD-1331339.1 | AUCAACCAAAAUGUUAGAUCCA | 129 | | 1415-1435 | UGGAUCAACAUUUGAGUUUAACA | 258 | | 1413-1435 |
| AD-1331340.1 | UUAAAACUCUAAACUUGAGUA | 130 | | 1850-1870 | UAGUCAAGUUUGAGUUUUAACA | 259 | | 1848-1870 |
| AD-1331320.1 | CAAAACUUGAAAGCCUCCUAU | 131 | | 445-465 | ATAGGAGGCUUCAAGUUUUGAG | 240 | | 443-465 |
| AD-1331341.1 | UCAACAUCGAAUAGAUGGAUU | 132 | | 935-955 | AAUCCAUCUAUUCGAUGUUGAAU | 260 | | 933-955 |
| AD-1331322.1 | CAAAACUUCAAUGAAACGUGU | 133 | | 957-977 | ACACGUUUCAUUGAAGUUUUGUG | 242 | | 955-977 |
| AD-1331342.1 | AAUCACGAAACCAACUAUACU | 134 | | 1137-1157 | AGUAUAGUUGGUUUCGUGAUUUC | 261 | | 1135-1157 |
| AD-1331343.1 | GGGAAUCAAUUUAGAUGGGUU | 135 | | 1695-1715 | AACCAUCUAAAAUUGAUCCCAC | 262 | | 1693-1715 |
| AD-1331325.1 | CAAAAAUGUUGAUCCAUCCAAU | 136 | | 1421-1441 | AUGGAUGGAUCAACAAUUUGGU | 245 | | 1419-1441 |
| AD-1331344.1 | UGGACAUUAAUUCAACAUCGA | 137 | | 924-944 | UCGAUGUUGAAUUAAUGUCCAUG | 263 | | 922-944 |

TABLE 3

Modified Sense and Antisense Strand Sequences of ANGPTL3 dsRNA Agents

| Duplex Name | Sense Sequence 5' to 3' | SEQ ID NO: | Antisense Sequence 5' to 3' | SEQ ID NO: | mRNA Target Sequence 5' to 3' | SEQ ID NO: |
|---|---|---|---|---|---|---|
| AD-1331197.1 | asusaaaaAfuGfUfUfcacaauuaauL96 | 264 | asUfsuaaUfugugaacAfuUfuuuauscsu | 372 | AGAUAAAAAUGUUCACAAUUAAG | 503 |
| AD-1331198.1 | usasaaaaUfgUfUfCfacaauuaaguL96 | 265 | asCfsuuaAfuugugaaCfaUfuuuuasusc | 373 | GAUAAAAAUGUUCACAAUUAAGC | 504 |
| AD-1331199.1 | asasaaauGfuUfCfAfcaauuaagcuL96 | 266 | asGfscuuAfauugugaAfcAfuuuuusasu | 374 | AUAAAAAUGUUCACAAUUAAGCU | 505 |
| AD-1331200.1 | asasaaugUfuCfAfCfaauuaagcuuL96 | 267 | asAfsgcuUfaauugugAfaCfauuuusasu | 375 | UAAAAAUGUUCACAAUUAAGCUC | 506 |
| AD-1331201.1 | asasauguUfcAfCfAfauuaagcucuL96 | 268 | asGfsagdCu(Tgn)aauuguGfaAfcauuususu | 376 | AAAAAUGUUCACAAUUAAGCUCC | 507 |
| AD-1331202.1 | asusguucAfcAfAfUfuaagcuccuuL96 | 269 | asAfsggdAg(C2p)uuaauuGfuGfaacaususu | 377 | AAAUGUUCACAAUUAAGCUCCUU | 508 |
| AD-1331203.1 | usgsuucaCfaAfUfUfaagcuccuuuL96 | 270 | asAfsagdGa(G2p)cuuaauUfgUfgaacasusu | 378 | AAUGUUCACAAUUAAGCUCCUUC | 509 |
| AD-1331204.1 | gsusucacAfaUfUfUfagcuccuucuL96 | 271 | asGfsaadGg(Agn)gcuuaaUfuGfugaacsasu | 379 | AUGUUCACAAUUAAGCUCCUUCU | 510 |
| AD-1331205.1 | ususcacaAfuUfAfAfgcuccuucuuL96 | 272 | asAfsgadAg(G2p)agcuuaAfuUfgugaascsa | 380 | UGUUCACAAUUAAGCUCCUUCUU | 511 |
| AD-66977.2 | uscsacaaUfuAfAfGfcuccuucuuuL96 | 273 | asAfsagaAfggagcuuAfaUfugugasasc | 381 | GUUCACAAUUAAGCUCCUUCUUU | 512 |
| AD-1331206.1 | csascaauUfaAfGfCfuccuucuuuuL96 | 274 | asAfsaagAfaggagcuUfaAfuugugsasa | 382 | UUCACAAUUAAGCUCCUUCUUUU | 513 |
| AD-1331207.1 | ascsaauuAfaGfCfUfccuucuuuuuL96 | 275 | asAfsaaaGfaaggagcUfuAfauugusgsa | 383 | UCACAAUUAAGCUCCUUCUUUUU | 514 |
| AD-1331208.1 | csasauuaAfgCfUfCfcuucuuuuuuL96 | 276 | asAfsaaaAfgaaggagCfuUfaauugsusg | 384 | CACAAUUAAGCUCCUUCUUUUUA | 515 |
| AD-1331209.1 | asasuuaaGfcUfCfCfuucuuuuauL96 | 277 | asUfsaaaAfgaaggaGfcUfuaauusgsu | 385 | ACAAUUAAGCUCCUUCUUUUAU | 516 |
| AD-67003.3 | asusuaagCfuCfCfUfucuuuuauuL96 | 278 | asAfsuaaAfaagaaggAfgCfuuaaususg | 386 | CAAUUAAGCUCCUUCUUUUAUU | 517 |
| AD-1331210.1 | ususaagcUfcCfUfUfcuuuuauuuL96 | 279 | asAfsauaAfaagaagGfaGfcuuaasusu | 387 | AAUUAAGCUCCUUCUUUUAUUG | 518 |
| AD-1331211.1 | usasagcuCfcUfUfCfuuuuauuguL96 | 280 | asCfsaauAfaaaagaGfaGfgcuuasasu | 388 | AUUAAGCUCCUUCUUUUAUUGU | 519 |
| AD-1331212.1 | asasgcucCfuUfCfUfuuuuauuguuL96 | 25 | asAfscaaUfaaaagaAfgGfagcuusasa | 22 | UUAAGCUCCUUCUUUUAUUGUU | 520 |
| AD-1331213.1 | asgscuccUfuCfUfUfuuuauuguuuL96 | 281 | asAfsacaAfuaaaagAfaGfgagcususa | 24 | UAAGCUCCUUCUUUUAUUGUUC | 521 |
| AD-1331214.1 | gscsuccuUfcUfUfUfuauuguucuL96 | 282 | asGfsaacAfauaaaaGfaAfggagcsusu | 389 | AAGCUCCUUCUUUUAUUGUUCC | 522 |
| AD-1331215.1 | csusccuuCfuUfUfUfuauuguuccuL96 | 283 | asGfsguaCfaauaaaaAfgAfaggagscsu | 390 | AGCUCCUUCUUUUAUUGUUCCU | 523 |
| AD-1331216.1 | uscscuucUfuUfUfUfauuguuccuuL96 | 284 | asAfsggaAfcaauaaaAfaGfaaggasgsc | 391 | GCUCCUUCUUUUAUUGUUCCUC | 524 |
| AD-1331217.1 | cscsuucuUfuUfUfAfuuguuccucuL96 | 285 | asGfsaggAfacaauaaAfaAfgaaggsasg | 392 | CUCCUUCUUUUAUUGUUCCUCU | 525 |
| AD-1331218.1 | csusucuuUfuUfAfUfuguuccucuaL96 | 286 | usAfsgadGg(Agn)acaauaAfaAfagaagsgsa | 393 | UCCUUCUUUUAUUGUUCCUCUA | 526 |
| AD-1331220.1 | uscsuuuuUfaUfUfGfuuccucuaguL96 | 287 | asCfsuadGa(G2p)gaacaaUfaAfaaagasasg | 394 | CUUCUUUUAUUGUUCCUCUAGU | 527 |

TABLE 3-continued

Modified Sense and Antisense Strand Sequences of ANGPTL3 dsRNA Agents

| Duplex Name | Sense Sequence 5' to 3' | SEQ ID NO: | Antisense Sequence 5' to 3' | SEQ ID NO: | mRNA Target Sequence 5' to 3' | SEQ ID NO: |
|---|---|---|---|---|---|---|
| AD-1331221.1 | csusuuuuAfuUfGfUfuccucuaguuL96 | 288 | asAfscudAg(Agn)ggaacaAfuAfaaaagsasa | 395 | UUCUUUUUAUUGUUCCUCUAGUU | 528 |
| AD-1331222.1 | ususuuuaUfuGfUfUfccucuaguuuL96 | 289 | asAfsacuAfgaggaacAfaUfaaaaasgsa | 396 | UCUUUUUAUUGUUCCUCUAGUUA | 529 |
| AD-1331223.1 | ususuuauUfgUfUfCfcucuaguauL96 | 290 | asUfsaacUfagaggaaCfaAfuaaaasasg | 397 | CUUUUUAUUGUUCCUCUAGUUAU | 530 |
| AD-1331224.1 | asusuucaAfaAfAfCfucaacauauuL96 | 291 | asAfsuadTg(Tgn)ugaguuUfuUfgaaausasu | 398 | AUAUUUCAAAAACUCAACAUAUU | 531 |
| AD-1331225.1 | ususucaaAfaAfCfUfcaacauauuuL96 | 292 | asAfsaudAu(G2p)uugaguUfuUfgaaasusa | 399 | UAUUUCAAAAACUCAACAUAUUU | 532 |
| AD-1331226.1 | ususcaaaAfaCfUfCfaacauauuuL96 | 293 | asAfsaauAfuguugagUfuUfuugaasasu | 400 | AUUUCAAAAACUCAACAUAUUUG | 533 |
| AD-1331227.1 | uscsaaaaAfcUfCfAfacauauuuguL96 | 294 | asCfsaaaUfauguugaGfuUfuuugasasa | 401 | UUUCAAAAACUCAACAUAUUUGA | 534 |
| AD-1331228.1 | csasaaaaCfuCfAfAfcauauuugauL96 | 295 | asUfscaaAfuauguugAfgUfuuuugsasa | 402 | UUCAAAAACUCAACAUAUUUGAU | 535 |
| AD-1331229.1 | asasaaacUfcAfAfCfauauuugauuL96 | 296 | asAfsucaAfauauguuGfaGfuuuuusgsa | 403 | UCAAAAACUCAACAUAUUUGAUC | 536 |
| AD-1331230.1 | asasaacuCfaAfCfAfuauuugaucuL96 | 297 | asGfsaucAfaauauguUfgAfguuuususg | 404 | CAAAAACUCAACAUAUUUGAUCA | 537 |
| AD-1331231.1 | asasacucAfaCfAfUfauuugaucauL96 | 298 | asUfsgadTc(Agn)aauaugUfuUfgaguuususu | 405 | AAAAACUCAACAUAUUUGAUCAG | 538 |
| AD-1331232.1 | asascucaAfcUfAfUfuugaucaguL96 | 299 | asCfsugaUfcaaauauGfuUfgaguususu | 406 | AAAACUCAACAUAUUUGAUCAGU | 539 |
| AD-1331233.1 | ascsucaaCfaUfAfUfuugaucaguL96 | 300 | asAfscudGa(Tgn)caaauaUfgUfugagususu | 407 | AAACUCAACAUAUUUGAUCAGUC | 540 |
| AD-1331234.1 | uscsaacaUfaUfUfUfgaucagucuuL96 | 301 | asAfsgadCu(G2p)aucaaaUfaUfguugasgsu | 408 | ACUCAACAUAUUUGAUCAGUCUU | 541 |
| AD-67031.2 | csasacauAfuUfUfGfaucagucuuuL96 | 302 | asAfsagaCfugaucaaAfuAfuguugsasg | 409 | CUCAACAUAUUUGAUCAGUCUUU | 542 |
| AD-1331235.1 | asascauaUfuUfGfAfucagucuuuL96 | 303 | asAfsaadGa(C2p)ugaucaAfaUfauguusgsa | 410 | UCAACAUAUUUGAUCAGUCUUUU | 543 |
| AD-65695.22 | ascsauauUfuGfAfUfcagucuuuuL96 | 304 | asAfsaaaGfacugaucAfaAfuaugususg | 411 | AAAAGACUGAUCAAAUAUGUUG | 544 |
| AD-1331236.1 | csasuauuUfgAfUfCfagucuuuuL96 | 305 | asAfsaaaAfgacugauCfaAfauaugsusu | 412 | AACAUAUUUGAUCAGUCUUUUA | 545 |
| AD-1331237.1 | asusauuuGfaUfCfAfgucuuuuauL96 | 306 | asUfsaaaAfagacugaUfcAfaauausgsu | 413 | ACAUAUUUGAUCAGUCUUUUAU | 546 |
| AD-1331238.1 | usasuuugAfuCfAfGfucuuuuauuL96 | 307 | asAfsuaaAfaagacugAfuCfaaauasusg | 414 | CAUAUUUGAUCAGUCUUUUAUG | 547 |
| AD-1331239.1 | asusuugaUfcAfGfUfcuuuuauguL96 | 308 | asCfsauaAfaaagacuGfaUfcaaausasu | 415 | AUAUUUGAUCAGUCUUUUAUGA | 548 |
| AD-1331240.1 | ususugauCfaGfUfCfuuuuauguL96 | 309 | asUfscauAfaaaagacUfgAfucaaasusa | 416 | UAUUUGAUCAGUCUUUUAUGAU | 549 |
| AD-1331241.1 | ususgaucAfgUfCfUfuuuuaugauuL96 | 310 | asAfsucaUfaaaaagaCfuGfaucaasasu | 417 | AUUUGAUCAGUCUUUUAUGAUC | 550 |
| AD-1331242.1 | usgsaucaGfuCfUfUfuuuaugaucuL96 | 311 | asGfsaudCa(Tgn)aaaaagAfcUfgaucasasa | 418 | UUUGAUCAGUCUUUUAUGAUCU | 551 |

TABLE 3-continued

Modified Sense and Antisense Strand Sequences of ANGPTL3 dsRNA Agents

| Duplex Name | Sense Sequence 5' to 3' | SEQ ID NO: | Antisense Sequence 5' to 3' | SEQ ID NO: | mRNA Target Sequence 5' to 3' | SEQ ID NO: |
|---|---|---|---|---|---|---|
| AD-1331243.1 | gsasucagUfcUfUfUfuuaugaucuaL96 | 312 | usAfsgadTc(Agn)uaaaaa GfaCfugaucsasa | 419 | UUGAUCAGUCUUUUUAUGA UCUA | 552 |
| AD-1331244.1 | asuscaguCfuUfUfUfuaugaucuauL96 | 313 | asUfsagdAu(C2p)auaaaa AfgAfcugauscsa | 420 | UGAUCAGUCUUUUUAUGAU CUAU | 553 |
| AD-1331245.1 | uscsagucUfuUfUfUfaugaucuauuL96 | 314 | asAfsuadGa(Tgn)cauaaa AfaGfacugasusc | 421 | GAUCAGUCUUUUUAUGAUC UAUC | 554 |
| AD-1331246.1 | csasgucuUfuUfUfAfugaucuaucuL96 | 315 | asGfsaudAg(Agn)ucauaa AfaAfgacugsasu | 422 | AUCAGUCUUUUUAUGAUCU AUCG | 555 |
| AD-1331247.1 | asgsucuuUfuUfAfUfgaucuaucguL96 | 316 | asCfsgauAfgaucauaAfaA fagacusgsa | 423 | UCAGUCUUUUUAUGAUCUA UCGC | 556 |
| AD-1331248.1 | gsuscuuUfuUfAfUfGfaucuaucgcuL96 | 317 | asGfscgaUfagaucauAfaA faagacsusg | 424 | CAGUCUUUUUAUGAUCUAU CGCU | 557 |
| AD-1331249.1 | uscsuuuUfaUfGfAfucuaucgcuuL96 | 318 | asAfsgcgAfuagaucaUfaA faaagascsu | 425 | AGUCUUUUUAUGAUCUAUC GCUG | 558 |
| AD-1331250.1 | csusuuuAfuGfAfUfcuaucgcuguL96 | 319 | asCfsagcGfauagaucAfuA faaaagsasc | 426 | GUCUUUUUAUGAUCUAUCG CUGC | 559 |
| AD-1331251.1 | asascuccAfgAfAfCfacccagaaguL96 | 320 | asCfsuudCu(G2p)gguguu CfuGfgaguususc | 427 | GAAACUCCAGAACACCCAG AAGU | 560 |
| AD-1331252.1 | ascsuccaGfaAfCfAfcccagaaguaL96 | 321 | usAfscudTc(Tgn)gggugu UfcCfggagususu | 428 | AAACUCCAGAACACCCAGA AGUA | 561 |
| AD-1331253.1 | csusccagAfaCfAfCfccagaaguaaL96 | 322 | usUfsacdTu(C2p)ugggug UfuCfuggagsusu | 429 | AACUCCAGAACACCCAGAA GUAA | 562 |
| AD-1331254.1 | uscscagaAfcAfCfCfcagaaguaaL96 | 323 | asUfsuadCu(Tgn)cugggu GfuUfcuggasgsu | 430 | ACUCCAGAACACCCAGAAG UAAC | 563 |
| AD-1331255.1 | cscsagaaCfaCfCfCfagaaguaacuL96 | 324 | asGfsuudAc(Tgn)ucuggg UfgUfucuggsasg | 431 | CUCCAGAACACCCAGAAGU AACU | 564 |
| AD-1331256.1 | csasgaacAfcCfCfCfAfgaaguaacuuL96 | 325 | asAfsgudTa(C2p)uucugg GfuGfuucugsgsa | 432 | UCCAGAACACCCAGAAGUA ACUU | 565 |
| AD-1331257.1 | asgsaacaCfcCfCfAfGfaaguaacuuuL96 | 326 | asAfsaguUfacuucugGfgU fguucusgsg | 433 | CCAGAACACCCAGAAGUAA CUUC | 566 |
| AD-1331258.1 | gsasacacCfcAfGfAfaguaacuucaL96 | 327 | usGfsaadGu(Tgn)acuucu GfgGfuguucsusg | 434 | CAGAACACCCAGAAGUAAC UUCA | 567 |
| AD-1331259.1 | asascaccCfaGfAfAfguaacuucauL96 | 328 | asUfsgadAg(Tgn)uacuuc UfgGfguguuscsu | 435 | AGAACACCCAGAAGUAACU UCAC | 568 |
| AD-1331260.1 | ascsacccAfgAfAfGfuaacuucacuL96 | 329 | asGfsugdAa(G2p)uuacuu CfuGfgguguscs | 436 | GAACACCCAGAAGUAACUU CACU | 569 |
| AD-1331261.1 | csasccccaGfaAfGfUfaacuucacuL96 | 330 | asAfsgudGa(Agn)guuacu UfcUfgggugsusu | 437 | AACACCCAGAAGUAACUUC ACUU | 570 |
| AD-1331262.1 | ascsccagAfaGfUfAfacuucacuuL96 | 331 | asAfsaguGfaaguuacUfuC fugggusgsu | 438 | ACACCCAGAAGUAACUUCA CUUA | 571 |
| AD-1331263.1 | cscscagaAfgUfAfAfcuucacuuaaL96 | 332 | usFfsaadGu(G2p)aaguua CfuUfcugggsusg | 439 | CACCCAGAAGUAACUUCAC UUAA | 572 |
| AD-1331264.1 | cscsagaaGfuAfAfCfuucacuuaaaL96 | 333 | usUfsuadAg(Tgn)gaaguu AfcUfucuggsgsu | 440 | ACCCAGAAGUAACUUCACU UAAA | 573 |
| AD-1331265.1 | csasgaagUfaAfCfUfucacuuaaaaL96 | 334 | usUfsuudAa(G2p)ugaagu UfaCfuucugsgsg | 441 | CCCAGAAGUAACUUCACUU AAAA | 574 |
| AD-1331266.1 | asgsaaguAfaCfUfUfcacuuaaaauL96 | 335 | asUfsuuuAfagugaagUfuA fcuucusgsg | 442 | CCAGAAGUAACUUCACUUA AAAC | 575 |
| AD-1331267.1 | gsasaguaAfcUfUfCfacuuaaaacuL96 | 336 | asGfsuuuUfaagugaaGfuU facuucsusg | 443 | CAGAAGUAACUUCACUUAA AACU | 576 |

TABLE 3-continued

Modified Sense and Antisense Strand Sequences of ANGPTL3 dsRNA Agents

| Duplex Name | Sense Sequence 5' to 3' | SEQ ID NO: | Antisense Sequence 5' to 3' | SEQ ID NO: | mRNA Target Sequence 5' to 3' | SEQ ID NO: |
|---|---|---|---|---|---|---|
| AD-1331268.1 | asasguaaCfuUfCfAfcuuaaaacuuuL96 | 337 | asAfsguuUfuaagugaAfgU fuacuuscsu | 444 | AGAAGUAACUUCACUUAAA ACUU | 577 |
| AD-1331269.1 | asgsuaacUfuCfAfCfuuaaaacuuuL96 | 338 | asAfsaguUfuuaagugAfaG fuuacususc | 445 | GAAGUAACUUCACUUAAAA CUUU | 578 |
| AD-1331270.1 | gsusaacuUfcAfCfUfuaaaacuuuuL96 | 339 | asAfsaagUfuuuaaguGfaA fguuacsusu | 446 | AAGUAACUUCACUUAAAAC UUUU | 579 |
| AD-1331271.1 | usasacuuCfaCfUfUfaaaacuuuuL96 | 340 | asAfsaaaGfuuuuaagUfgA faguuascsu | 447 | AGUAACUUCACUUAAAACU UUUG | 580 |
| AD-1331272.1 | asascuucAfcUfUfAfaaacuuuuguL96 | 341 | asCfsaaaAfguuuuaaGfuG faaguusasc | 448 | GUAACUUCACUUAAAACUU UUGU | 581 |
| AD-1331273.1 | ascsuucaCfuUfAfAfaacuuuuguuL96 | 342 | asAfscaaAfaguuuuaAfgU fgaagususa | 449 | UAACUUCACUUAAAACUUU UGUA | 582 |
| AD-1331274.1 | csusucacUfuAfAfAfacuuuuguauL96 | 343 | asUfsacaAfaaguuuuAfaG fugaagsusu | 450 | AACUUCACUUAAAACUUUU GUAG | 583 |
| AD-1331275.1 | ususcacuUfaAfAfAfcuuuuguaguL96 | 344 | asCfsuacAfaaaguuuUfaA fgugaasgsu | 451 | ACUUCACUUAAAACUUUUG UAGA | 584 |
| AD-1331276.1 | uscsacuuAfaAfAfCfuuuuguagauL96 | 345 | asUfscuaCfaaaaguuUfuA faguugasasg | 452 | CUUCACUUAAAACUUUUGU AGAA | 585 |
| AD-1331277.1 | csascuuaAfaAfCfUfuuuguagaaaL96 | 346 | usUfsucdTa(C2p)aaaagu UfuUfaaguguasasa | 453 | UUCACUUAAAACUUUUGUA GAAA | 586 |
| AD-1331278.1 | ascsuuaaAfaCfUfUfuuguagaaaaL96 | 347 | usUfsuudCu(Agn)caaaag UfuUfuaagususga | 454 | UCACUUAAAACUUUUGUAG AAAA | 587 |
| AD-1331279.1 | asasuguucaCfAfAfuuaagcuccuL96 | 348 | asdGsgadGcdTuaaudTgU fgaacauususu | 455 | AAAAUGUUCACAAUUAAGC UCCU | 588 |
| AD-1331280.1 | asusuugcuaUfGfUfuagacgauguL96 | 349 | asdCsaudCgdTcuaadCaU fagcaaauscsu | 456 | AGAUUUGCUAUGUUAGACG AUGU | 589 |
| AD-1331281.1 | ususgcuaugUfUfAfgacgauguaaL96 | 350 | usdTsacdAudCgucudAaC fauagcaasasu | 457 | AUUUGCUAUGUUAGACGAU GUAA | 590 |
| AD-1331282.1 | usgscuauguUfAfGfacgauguaaaL96 | 351 | usdTsuadCadTcgucdTaA fcauagcasasa | 458 | UUUGCUAUGUUAGACGAUG UAAA | 591 |
| AD-1331283.1 | asascugagaAfGfFfacuacauauaL96 | 352 | usdAsuadTgdTaguudCuU fcucaguuscsc | 459 | GGAACUGAGAAGAACUACA UAUA | 592 |
| AD-1331284.1 | asasccaacaGfCfFfaugucaaauaL96 | 353 | usdAsuudTgdAcuaudGcU fguugguususa | 460 | UAACCAACAGCAUAGUCA AAUA | 593 |
| AD-1331285.1 | cscscacagaAfAfUfuucucuaucuL96 | 354 | asdGsaudAgdAgaaadTuU fcuguggsusu | 461 | AACCCACAGAAAUUUCUCU AUCU | 594 |
| AD-1331286.1 | csasgguaguCfCfAfuggacauuaaL96 | 355 | usdTsadTgdTccaudGgA fcuaccugsasu | 462 | AUCAGGUAGUCCAUGGACA UUAA | 595 |
| AD-1331287.1 | gsgsuaguccAfUfGfgacauuaauuL96 | 356 | asdAsuudAadTguccdAuG fgacuaccsusg | 463 | CAGGUAGUCCAUGGACAUU AAUU | 596 |
| AD-1331288.1 | asgsuuggaaGfAfCfuggaaagacaL96 | 357 | usdGsucdTudTccagdTcU fuccaacuscsa | 464 | UGAGUGGAAGACUGGAAA GACA | 597 |
| AD-1331289.1 | usgsgaaagaCfAfAfcaaacauuauL96 | 358 | asdTsadTgdTuugudTgU fcuuuccasgsu | 465 | ACUGGAAAGACAACAAACA UUAU | 598 |
| AD-1331290.1 | ususuacuugGfGfAfaaucacgaaaL96 | 359 | usdTsucdGudGauuudCcC faaguaaasasa | 466 | UUUUUACUUGGGAAAUCAC GAAA | 599 |

TABLE 3-continued

Modified Sense and Antisense Strand Sequences of ANGPTL3 dsRNA Agents

| Duplex Name | Sense Sequence 5' to 3' | SEQ ID NO: | Antisense Sequence 5' to 3' | SEQ ID NO: | mRNA Target Sequence 5' to 3' | SEQ ID NO: |
|---|---|---|---|---|---|---|
| AD-1331291.1 | gsgsgaaaucAfCfGfaaaccaacuaL96 | 360 | usdAsgudTgdGuuucdGuGfauuucccsasa | 467 | UUGGGAAAUCACGAAACCAACUA | 600 |
| AD-1331292.1 | gsasaaucacGfAfAfaccaacuauaL96 | 361 | usdAsuadGudTgguudTcGfugauuucscsc | 468 | GGGAAAUCACGAAACCAACUAUA | 601 |
| AD-1331293.1 | csgsaaaccaAfCfUfauacgcuacaL96 | 362 | usdGsuadGcdGuauadGuUfgguuucgsusg | 469 | CACGAAACCAACUAUACGCUACA | 602 |
| AD-1331294.1 | asuscaaccaAfAfAfuguugauccaL96 | 363 | usdGsgadTcdAacaudTuUfgguugaususu | 470 | AAAUCAACCAAAAUGUUGAUCCA | 603 |
| AD-1331295.1 | ususaaaacuCfUfAfaacuugacuaL96 | 364 | usdAsgudCadAguuudTgAfguuuuaascsa | 471 | UGUUAAAACUCUAAACUUGACUA | 604 |
| AD-1331296.1 | csasaaacuuGfAfAfagccuccuauL96 | 365 | asdTsagdGadGgcuudTcAfaguuuugsasg | 472 | CUCAAAACUUGAAAGCCUCCUAG | 605 |
| AD-1331297.1 | uscsaacaucGfAfAfuagauggauuL96 | 366 | asdAsucdCadTcuaudTcGfauguugasasu | 473 | AUUCAACAUCGAAUAGAUGGAUC | 606 |
| AD-1331298.1 | csasaaacuuCfAfAfugaaacguguL96 | 367 | asdCsacdGudTucaudTgAfaguuuugsusg | 474 | CACAAAACUUCAAUGAAACGUGG | 607 |
| AD-1331299.1 | asasucacgaAfAfCfcaacuauacuL96 | 368 | asdGsuadTadGuuggdTuUfcgugauususc | 475 | GAAAUCACGAAACCAACUAUACG | 608 |
| AD-1331300.1 | gsgsgaaucaAfUfUfuuagaugguuL96 | 369 | asdAsccdAudCuaaadAuUfgauucccsasc | 476 | GUGGGAAUCAAUUUUAGAUGGUC | 609 |
| AD-1331301.1 | csasaaauguUfGfAfuccauccaauL96 | 370 | asdTsugdGadTggaudCaAfcauuuugsgsu | 477 | ACCAAAAUGUUGAUCCAUCCAAC | 610 |
| AD-1331302.1 | usgsgacauuAfAfUfucaacaucgaL96 | 371 | usdCsgadTgdTugaadTuAfauguccasusg | 478 | CAUGGACAUUAAUUCAACAUCGA | 611 |
| AD-1331328.1 | asasuguucaCfAfAfuuaagcuccuL96 | 348 | asdGsgadGcdTuaaudTgdTgdAacauususu | 479 | AAAAUGUUCACAAUUAAGCUCCU | 588 |
| AD-1331329.1 | asusuugcuaUfGfUfuagacgauguL96 | 349 | asdCsaudCgdTcuaadCadTadGcaaauscsu | 480 | AGAUUUGCUAUGUUAGACGAUGU | 589 |
| AD-1331330.1 | ususgcuaugUfUfAfgacgauguaaL96 | 350 | usdTsacdAudCgucudAadCadTagcaasasu | 481 | AUUUGCUAUGUUAGACGAUGUAA | 590 |
| AD-1331306.1 | usgscuauguUfAfGfacgauguaaaL96 | 351 | usdTsuadCadTcgucdTadAcdAuagcasasa | 482 | UUUGCUAUGUUAGACGAUGUAAA | 591 |
| AD-1331331.1 | asascugagaAfGfAfacuacauauaL96 | 352 | usdAsuadTgdTaguudCudTcdTcaguuscsc | 483 | GGAACUGAGAAGAACUACAUAUA | 592 |
| AD-1331332.1 | asasccaacaGfCfAfuagucaaauaL96 | 353 | usdAsuudTgdAcuaudGcdTgdTgguususa | 484 | UAAACCAACAGCAUAGUCAAAUA | 593 |
| AD-1331333.1 | cscscacagaAfAfUfuucucuaucuL96 | 354 | asdGsaudAgdAgaaadTudTcdTgugggsusu | 485 | AACCCACAGAAAUUUCUCUAUCU | 594 |
| AD-1331334.1 | csasgguaguCfCfAfuggacauuaaL96 | 355 | usdTsaadTgdTccaudGgdAcdTaccugsasu | 486 | AUCAGGUAGUCCAUGGACAUUAA | 595 |
| AD-1331311.1 | gsgsuaguccAfUfGfgacauuaauuL96 | 356 | asdAsuudAadTguccdAudGgdAcuaccsusg | 487 | CAGGUAGUCCAUGGACAUUAAUU | 596 |
| AD-1331335.1 | asgsuuggaaGfAfCfuggaaagacaL96 | 357 | usdGsucdTudTccagdTcdTudCcaacuscsa | 488 | UGAGUUGGAAGACUGGAAAGACA | 597 |
| AD-1331336.1 | usgsgaaagaCfAfAfcaaacauuauL96 | 358 | asdTsaadTgdTuugudTgdTcdTuuccasgsu | 489 | ACUGGAAAGACAACAAACAUUAU | 598 |
| AD-1331314.1 | ususuacuugGfGfAfaaucacgaaaL96 | 359 | usdTscdGudGauuudCcdCadAguaaasasa | 490 | UUUUUACUUGGGAAAUCACGAAA | 599 |
| AD-1331337.1 | gsgsgaaaucAfCfGfaaaccaacuaL96 | 360 | usdAsgudTgdGuuucdGudGadTuucccsasa | 491 | UUGGGAAAUCACGAAACCAACUA | 600 |

TABLE 3-continued

Modified Sense and Antisense Strand Sequences of ANGPTL3 dsRNA Agents

| Duplex Name | Sense Sequence 5' to 3' | SEQ ID NO: | Antisense Sequence 5' to 3' | SEQ ID NO: | mRNA Target Sequence 5' to 3' | SEQ ID NO: |
|---|---|---|---|---|---|---|
| AD-1331316.1 | gsasaaucacGfAfAfaccaacuauaL96 | 361 | usdAsuadGudTgguudTcdGudGauuucscsc | 492 | GGGAAAUCACGAAACCAACUAUA | 601 |
| AD-1331338.1 | csgsaaaecaAfCfUfauacgcuacaL96 | 362 | usdGsuadGcdGuauadGudTgdGuuucgsusg | 493 | CACGAAACCAACUAUACGCUACA | 602 |
| AD-1331339.1 | asuscaaccaAfAfAfuguugauccaL96 | 363 | usdGsgadTcdAacaudTudTgdGuugaususu | 494 | AAAUCAACCAAAAUGUUGAUCCA | 603 |
| AD-1331340.1 | ususaaaacuCfUfAfaacuugacuaL96 | 364 | usdAsgudCadAguuudTgdAgdTuuuaascsa | 495 | UGUUAAAACUCUAAACUUGACUA | 604 |
| AD-1331320.1 | csasaaacuuGfAfAfagccuccuauL96 | 365 | asdTsagdGadGgcuudTcdAadGuuuugsasg | 496 | CUCAAAACUUGAAAGCCUCCUAG | 605 |
| AD-1331341.1 | uscsaacaucGfAfAfuagauggauuL96 | 366 | asdAsucdCadTcuaudTcdGadTguugasasu | 497 | AUUCAACAUCGAAUAGAUGGAUC | 606 |
| AD-1331322.1 | csasaaacuuCfAfAfugaaacguguL96 | 367 | asdCsacdGudTucaudTgdAadGuuuugsusg | 498 | CACAAAACUUCAAUGAAACGUGG | 607 |
| AD-1331342.1 | asasucacgaAfAfCfcaacuauacuL96 | 368 | asdGsuadTadGuuggdTudTcdGugauususc | 499 | GAAAUCACGAAACCAACUAUACG | 608 |
| AD-1331343.1 | gsgsgaaucaAfUfUfuuagaugguuL96 | 369 | asdAsccdAudCuaaadAudTgdAuucccsasc | 500 | GUGGGAAUCAAUUUUAGAUGGUC | 609 |
| AD-1331325.1 | csasaaauguUfGfAfuccauccaauL96 | 370 | asdTsugdGadTggaudCadAcdAuuuugsgsu | 501 | ACCAAAAUGUUGAUCCAUCCAAC | 610 |
| AD-1331344.1 | usgsgacauuAfAfUfucaacaucgaL96 | 371 | usdCsgadTgdTugaadTudAadTguccasusg | 502 | CAUGGACAUUAAUUCAACAUCGA | 611 |

TABLE 4

ANGPTL3 Dose Screen in Primary Cynomolgus Hepatocytes (PCH)

| | 10 nM | | 1 nM | | 0.1 nM | |
|---|---|---|---|---|---|---|
| DuplexID | % Avg Cyno Message Remaining | STDEV | % Avg Cyno Message Remaining | STDEV | % Avg Cyno Message Remaining | STDEV |
| AD-1331197.1 | 17.2 | 4.9 | 17.2 | 3.1 | 42.1 | 16.6 |
| AD-1331198.1 | 18.7 | 3.3 | 15.6 | 9.8 | 117.6 | 10.7 |
| AD-1331199.1 | 22.5 | 3.2 | 20.6 | 1.2 | 79.0 | 20.6 |
| AD-1331200.1 | 16.0 | 2.3 | 10.7 | 6.4 | 47.0 | 14.5 |
| AD-1331201.1 | 33.2 | 1.5 | 22.1 | 13.9 | 95.6 | 3.0 |
| AD-1331202.1 | 15.4 | 5.8 | 12.2 | 1.2 | 34.2 | 11.8 |
| AD-1331203.1 | 14.2 | 1.6 | 10.3 | 3.7 | 32.6 | 5.9 |
| AD-1331204.1 | 21.4 | 1.5 | 15.2 | 0.9 | 73.1 | 4.2 |
| AD-1331205.1 | 21.7 | 5.5 | 15.6 | 0.2 | 40.1 | 11.3 |
| AD-66977.2 | 19.3 | 2.6 | 17.4 | 2.6 | 39.2 | 4.8 |
| AD-1331206.1 | 16.0 | 9.0 | 11.2 | 1.1 | 18.6 | 4.9 |
| AD-1331207.1 | 17.9 | 6.0 | 10.2 | 3.2 | 24.2 | 8.9 |
| AD-1331208.1 | 19.4 | 4.5 | 11.8 | 0.9 | 29.1 | 12.6 |
| AD-1331209.1 | 10.9 | 2.8 | 11.9 | 2.9 | 27.6 | 3.9 |
| AD-67003.3 | 13.7 | 3.3 | 11.8 | 1.3 | 27.0 | 5.0 |
| AD-1331210.1 | 23.2 | 5.8 | 24.6 | 1.8 | 58.4 | 15.3 |
| AD-1331211.1 | 25.9 | 8.3 | 22.5 | 0.3 | 68.1 | 11.4 |
| AD-1331212.1 | 13.0 | 5.2 | 12.5 | 0.8 | 33.4 | 10.7 |
| AD-1331213.1 | 23.1 | 9.0 | 8.5 | 0.5 | 22.1 | 3.1 |
| AD-1331214.1 | 25.9 | 13.0 | 27.5 | 6.1 | 69.5 | 13.3 |
| AD-1331215.1 | 16.6 | 4.3 | 18.2 | 3.7 | 53.0 | 9.2 |
| AD-1331216.1 | 18.3 | 4.1 | 17.8 | 4.0 | 44.0 | 6.5 |
| AD-1331217.1 | 27.5 | 8.6 | 29.8 | 5.2 | 81.8 | 21.5 |
| AD-1331218.1 | 21.2 | 2.2 | 26.7 | 6.2 | 63.5 | 9.7 |
| AD-1331220.1 | 36.0 | 7.5 | 26.5 | 4.0 | 59.7 | 6.7 |
| AD-1331221.1 | 34.7 | 0.3 | 55.1 | 5.0 | 89.3 | 12.3 |
| AD-1331222.1 | 17.4 | 2.6 | 17.3 | 4.2 | 43.6 | 12.2 |

TABLE 4-continued

ANGPTL3 Dose Screen in Primary Cynomolgus Hepatocytes (PCH)

| | 10 nM | | 1 nM | | 0.1 nM | |
|---|---|---|---|---|---|---|
| DuplexID | % Avg Cyno Message Remaining | STDEV | % Avg Cyno Message Remaining | STDEV | % Avg Cyno Message Remaining | STDEV |
| AD-1331223.1 | 13.6 | 1.5 | 16.0 | 2.8 | 39.7 | 10.0 |
| AD-1331224.1 | 23.3 | 4.0 | 28.5 | 5.4 | 60.3 | 15.5 |
| AD-1331225.1 | 20.3 | 7.8 | 18.8 | 1.4 | 50.5 | 9.5 |
| AD-1331226.1 | 14.6 | 3.0 | 13.3 | 4.7 | 46.2 | 11.3 |
| AD-1331227.1 | 23.7 | 11.6 | 26.2 | 6.6 | 65.2 | 6.1 |
| AD-1331228.1 | 14.8 | 1.9 | 10.3 | 0.7 | 25.9 | 2.4 |
| AD-1331229.1 | 16.6 | 5.2 | 13.0 | 1.8 | 38.6 | 17.3 |
| AD-1331230.1 | 14.3 | 4.1 | 13.2 | 1.9 | 44.4 | 12.4 |
| AD-1331231.1 | 27.2 | 6.0 | 29.9 | 6.4 | 68.0 | 13.1 |
| AD-1331232.1 | 32.7 | 7.9 | 64.6 | 4.1 | 110.0 | 6.3 |
| AD-1331233.1 | 26.5 | 4.1 | 23.9 | 1.2 | 70.0 | 16.6 |
| AD-1331234.1 | 15.4 | 3.2 | 11.8 | 3.3 | 37.2 | 13.6 |
| AD-67031.2 | 12.3 | 1.3 | 9.6 | 3.3 | 31.4 | 5.3 |
| AD-1331235.1 | 19.7 | 12.5 | 10.2 | 0.5 | 21.3 | 6.7 |
| AD-65695.22 | 23.2 | 13.7 | 9.3 | 0.3 | 16.9 | 3.4 |
| AD-1331236.1 | 26.1 | 15.3 | 21.7 | 3.1 | 51.8 | 3.1 |
| AD-1331237.1 | 10.9 | 3.2 | 11.8 | 1.9 | 26.2 | 6.2 |
| AD-1331238.1 | 48.2 | 21.0 | 13.1 | 0.8 | 18.3 | 4.3 |
| AD-1331239.1 | 26.4 | 8.5 | 38.7 | 26.4 | 88.0 | 4.2 |
| AD-1331240.1 | 12.6 | 3.6 | 8.3 | 0.5 | 26.6 | 2.9 |
| AD-1331241.1 | 18.4 | 5.1 | 13.2 | 0.7 | 37.5 | 5.7 |
| AD-1331242.1 | 82.5 | 18.7 | 77.3 | 5.4 | 87.9 | 5.6 |
| AD-1331243.1 | 48.8 | 6.0 | 48.6 | 9.9 | 86.4 | 3.3 |
| AD-1331244.1 | 9.6 | 1.2 | 9.5 | 1.0 | 23.2 | 4.2 |
| AD-1331245.1 | 16.5 | 3.8 | 25.5 | 1.1 | 70.2 | 9.9 |
| AD-1331246.1 | 24.7 | 10.8 | 25.1 | 2.9 | 68.7 | 9.7 |
| AD-1331247.1 | 23.2 | 3.1 | 43.3 | 3.9 | 84.2 | 1.5 |
| AD-1331248.1 | 42.1 | 4.4 | 65.4 | 5.8 | 90.0 | 5.2 |
| AD-1331249.1 | 17.5 | 4.6 | 19.7 | 4.0 | 44.9 | 6.0 |
| AD-1331250.1 | 20.1 | 4.3 | 35.1 | 2.1 | 70.0 | 8.0 |
| AD-1331251.1 | 27.7 | 2.8 | 48.0 | 3.7 | 72.7 | 5.0 |
| AD-1331252.1 | 14.1 | 2.7 | 17.2 | 1.1 | 45.6 | 6.2 |
| AD-1331253.1 | 13.8 | 2.1 | 19.8 | 6.9 | 71.7 | 11.1 |
| AD-1331254.1 | 39.4 | 4.8 | 61.7 | 6.8 | 87.1 | 7.7 |
| AD-1331255.1 | 10.5 | 2.5 | 12.3 | 2.2 | 53.7 | 4.9 |
| AD-1331256.1 | 10.1 | 4.1 | 7.9 | 1.6 | 19.0 | 5.3 |
| AD-1331257.1 | 11.8 | 2.0 | 12.3 | 1.0 | 30.7 | 6.8 |
| AD-1331258.1 | 34.1 | 3.7 | 52.2 | 7.0 | 74.3 | 7.6 |
| AD-1331259.1 | 9.8 | 0.8 | 11.8 | 3.1 | 28.9 | 3.2 |
| AD-1331260.1 | 12.3 | 1.5 | 15.2 | 2.3 | 47.9 | 8.8 |
| AD-1331261.1 | 7.2 | 0.4 | 13.0 | 0.6 | 54.6 | 5.6 |
| AD-1331262.1 | 9.3 | 5.8 | 9.1 | 1.4 | 22.3 | 0.8 |
| AD-1331263.1 | 8.2 | 2.2 | 8.2 | 0.9 | 28.4 | 3.3 |
| AD-1331264.1 | 7.9 | 1.6 | 7.4 | 1.2 | 15.4 | 4.4 |
| AD-1331265.1 | 10.4 | 3.0 | 8.0 | 1.1 | 18.4 | 7.3 |
| AD-1331266.1 | 11.4 | 6.2 | 9.7 | 0.5 | 21.0 | 10.2 |
| AD-1331267.1 | 21.0 | 6.6 | 28.6 | 7.1 | 94.6 | 15.5 |
| AD-1331268.1 | 20.1 | 6.0 | 32.5 | 3.3 | 96.7 | 12.2 |
| AD-1331269.1 | 9.8 | 1.6 | 10.2 | 1.5 | 34.0 | 13.0 |
| AD-1331270.1 | 10.0 | 1.4 | 18.3 | 4.2 | 47.6 | 6.0 |
| AD-1331271.1 | 22.1 | 3.8 | 26.2 | 3.3 | 72.0 | 13.6 |
| AD-1331272.1 | 72.2 | 21.7 | 93.0 | 10.8 | 77.7 | 12.6 |
| AD-1331273.1 | 20.2 | 4.7 | 44.8 | 3.2 | 75.7 | 14.3 |
| AD-1331274.1 | 18.1 | 5.0 | 42.6 | 9.2 | 75.5 | 17.7 |
| AD-1331275.1 | 99.2 | 9.6 | 113.2 | 15.1 | 123.9 | 20.7 |
| AD-1331276.1 | 69.0 | 8.5 | 110.6 | 19.8 | 118.4 | 13.9 |
| AD-1331277.1 | 50.8 | 3.5 | 82.7 | 16.1 | 125.9 | 14.9 |
| AD-1331278.1 | 98.0 | 19.7 | 109.0 | 6.2 | 106.9 | 13.3 |
| AD-1331279.1 | 7.8 | 2.0 | 6.6 | 0.7 | 16.1 | 2.5 |
| AD-1331280.1 | 6.7 | 3.3 | 9.0 | 1.5 | 30.0 | 6.2 |
| AD-1331281.1 | 10.5 | 0.8 | 16.9 | 4.9 | 54.5 | 12.8 |
| AD-1331282.1 | 9.2 | 1.6 | 20.6 | 8.1 | 34.1 | 10.3 |
| AD-1331283.1 | 7.1 | 2.4 | 10.5 | N/A | 41.3 | 13.7 |
| AD-1331284.1 | 13.0 | 3.2 | 10.9 | N/A | 28.2 | 8.3 |
| AD-1331285.1 | 9.1 | 1.8 | 22.5 | 1.6 | 42.9 | 13.8 |
| AD-1331286.1 | 7.9 | 0.6 | 15.6 | 3.9 | 25.3 | 9.0 |
| AD-1331287.1 | 54.2 | 6.7 | 74.6 | 12.2 | 112.7 | 19.8 |
| AD-1331288.1 | 13.0 | 3.6 | 22.6 | 2.8 | 56.2 | 10.4 |
| AD-1331289.1 | 10.1 | 1.8 | 12.3 | 3.4 | 26.7 | 8.8 |
| AD-1331290.1 | 33.2 | 4.8 | 68.6 | 10.9 | 118.9 | 21.4 |
| AD-1331291.1 | 10.0 | 0.9 | 26.6 | 18.1 | 64.9 | 20.3 |
| AD-1331292.1 | 10.1 | 2.6 | 14.1 | 2.9 | 23.7 | 2.7 |

TABLE 4-continued

ANGPTL3 Dose Screen in Primary Cynomolgus Hepatocytes (PCH)

| | 10 nM | | 1 nM | | 0.1 nM | |
|---|---|---|---|---|---|---|
| DuplexID | % Avg Cyno Message Remaining | STDEV | % Avg Cyno Message Remaining | STDEV | % Avg Cyno Message Remaining | STDEV |
| AD-1331293.1 | 8.5 | 2.3 | 11.2 | 3.8 | 19.5 | 5.8 |
| AD-1331294.1 | 11.6 | 2.1 | 15.9 | 3.7 | 27.5 | 6.3 |
| AD-1331295.1 | 110.5 | 23.3 | 80.1 | 7.6 | 85.5 | 4.1 |
| AD-1331296.1 | 15.4 | 3.0 | 18.6 | 5.6 | 29.2 | 5.3 |
| AD-1331297.1 | 14.2 | 4.2 | 21.1 | 1.4 | 45.5 | 15.2 |
| AD-1331298.1 | 13.1 | 1.3 | 24.8 | 5.7 | 79.2 | 26.9 |
| AD-1331299.1 | 7.0 | 2.1 | 19.6 | 13.3 | 34.9 | 6.3 |
| AD-1331300.1 | 127.0 | 19.3 | 113.5 | 14.8 | 112.9 | 15.2 |
| AD-1331301.1 | 10.0 | 2.9 | 12.6 | 3.6 | 19.7 | 3.3 |
| AD-1331302.1 | 8.8 | 1.0 | 14.1 | 3.0 | 33.2 | 12.3 |
| AD-1331328.1 | 9.6 | 2.0 | 19.8 | 4.6 | 23.0 | 1.9 |
| AD-1331329.1 | 9.7 | 1.8 | 16.3 | 1.1 | 28.4 | 8.6 |
| AD-1331330.1 | 26.3 | 4.3 | 58.4 | 12.1 | 109.3 | 9.6 |
| AD-1331306.1 | 11.5 | 1.6 | 19.3 | 8.2 | 39.7 | 6.5 |
| AD-1331331.1 | 9.9 | 1.9 | 11.1 | 2.8 | 20.6 | 5.4 |
| AD-1331332.1 | 13.1 | 2.3 | 22.4 | 2.0 | 15.6 | 2.7 |
| AD-1331333.1 | 9.0 | 1.0 | 19.0 | 5.8 | 34.3 | 4.1 |
| AD-1331334.1 | 7.8 | 1.3 | 10.5 | 1.0 | 17.5 | 3.9 |
| AD-1331311.1 | 67.9 | 13.4 | 89.8 | 11.0 | 94.8 | 6.0 |
| AD-1331335.1 | 9.6 | 1.6 | 27.4 | 6.8 | 52.8 | 13.5 |
| AD-1331336.1 | 7.1 | 2.1 | 13.5 | 4.5 | 29.8 | 7.1 |
| AD-1331314.1 | 56.4 | 6.5 | 64.3 | 5.5 | 90.2 | 15.7 |
| AD-1331337.1 | 7.6 | 1.9 | 20.9 | 3.2 | 48.2 | 3.6 |
| AD-1331316.1 | 5.8 | 0.8 | 12.4 | 1.7 | 22.4 | 3.5 |
| AD-1331338.1 | 5.1 | 1.5 | 10.3 | 2.4 | 20.6 | 5.8 |
| AD-1331339.1 | 7.6 | 1.6 | 13.9 | 3.2 | 36.3 | 6.2 |
| AD-1331340.1 | 119.3 | 11.9 | 113.7 | 8.5 | 105.6 | 8.0 |
| AD-1331320.1 | 7.5 | 0.5 | 17.5 | 4.2 | 37.1 | 6.7 |
| AD-1331341.1 | 12.2 | 2.3 | 44.4 | 5.4 | 68.3 | 7.2 |
| AD-1331322.1 | 7.6 | 1.8 | 15.0 | 4.8 | 48.7 | 18.1 |
| AD-1331342.1 | 4.8 | 1.4 | 15.3 | 6.8 | 26.4 | 6.4 |
| AD-1331343.1 | 89.2 | 4.2 | 103.3 | 7.2 | 92.8 | 5.6 |
| AD-1331325.1 | 7.4 | 3.1 | 12.2 | 2.3 | 28.3 | 10.3 |
| AD-1331344.1 | 9.0 | 2.4 | 23.2 | 9.0 | 33.0 | 4.0 |

Example 3. In Vivo Screening of dsRNA Duplexes in Mice

Duplexes of interest, identified from the above in vitro studies, were evaluated in vivo. In particular, at pre-dose day −14 wild-type mice (C57BL/6) were transduced by intravenous administration of $2 \times 10^{11}$ viral particles of an adeno-associated virus 8 (AAV8) vector encoding human ANGPTL3. In particular, mice were administered an AAV8 encoding the open reading frame and 3' UTR of human ANGPTL3 mRNA referenced as NM_014495.3.

At day 0, groups of three mice were subcutaneously administered a single 3 mg/kg dose of the agents of interest (see Table 5) or PBS control. At day 7 or day 14 post-dose, serum samples were collected and the level of ANGPTL3 in the serum samples was measured by an ELISA assay. Results are shown with group means and standard deviation (SD) (FIG. 1A), and individual points plotted with SD (FIG. 1B). Treatment with the positive control, AD-74757, at 3 mg/kg resulted in 3 ng/mL or lower at Day 7 and Day 14 as expected. A cluster of several compounds resulted in levels of ANGPTL3 similar to or below the benchmark group (dotted line). Specifically, most of the compounds targeting the region of nucleotides 80-114 in human ANGPTL3 transcript, e.g., AD-1331203.1, AD-1331206.1, AD-1331209.1, AD-1331212.1 and AD-1331213.1, showed KD similar to AD-74757.

At day 14 post-dose, animals were sacrificed, liver samples were collected and snap-frozen in liquid nitrogen. Tissue mRNA was extracted and analyzed by the RT-QPCR method. Human ANGPTL3 mRNA levels were compared to housekeeping gene GAPDH. The values were then normalized to the average of PBS vehicle control group. The data were expressed as percent of baseline value, and presented as mean plus standard deviation. The results, shown in FIG. 2, demonstrate that the exemplary duplex agents tested effectively reduce the level of the human ANGPTL3 messenger RNA in vivo.

TABLE 5

Duplexes of Interest for In Vivo Screening

| Duplex Name | Range |
|---|---|
| AD-1331203.1 | 80-102 |
| AD-1331206.1 | 84-106 |
| AD-1331209.1 | 87-109 |
| AD-1331212.1 | 91-113 |
| AD-1331213.1 | 92-114 |
| AD-1331329.1 | 186-208 |
| AD-1331237.1 | 307-329 |
| AD-1331238.1 | 308-330 |
| AD-1331240.1 | 310-332 |
| AD-1331244.1 | 314-336 |
| AD-1331256.1 | 545-567 |
| AD-1331262.1 | 551-573 |
| AD-1331264.1 | 553-575 |
| AD-1331265.1 | 554-576 |
| AD-1331266.1 | 555-577 |
| AD-1331316.1 | 1133-1155 |

TABLE 5-continued

Duplexes of Interest for In Vivo Screening

| Duplex Name | Range |
|---|---|
| AD-1331338.1 | 1140-1162 |
| AD-74757 | 553-575 |

Example 4. Structure-Activity Relationship (SAR) Analyses

Based on the in vitro and the in vivo analyses in Examples 2 and 3, structure-active relationship (SAR) analyses were performed on selected duplexes (see Table 6). In particular, additional duplexes were designed, synthesized, and assayed in vitro and in vivo.

siRNAs were synthesized and annealed using routine methods known in the art and described above. In vitro screening assays in PCH cells and Hep3B cells with these siRNAs were performed as described above.

Detailed lists of the unmodified ANGPTL3 sense and antisense strand nucleotide sequences are shown in Table 7.

Detailed lists of the modified ANGPTL3 sense and antisense strand nucleotide sequences are shown in Table 8.

The results of the single dose screens of the dsRNA agents listed in Tables 7-8 in primary cynomolgus hepatocytes (PCH) are shown in Table 9.

The results of the single dose screens of the dsRNA agents listed in Tables 7-8 in Hep3B cells are shown in Table 10.

TABLE 6

Duplexes of Interest for SAR Analysis

| Duplex Name | Range |
|---|---|
| AD-1331203.1 | 80-102 |
| AD-1331206.1 | 84-106 |
| AD-1331209.1 | 87-109 |
| AD-1331212.1 | 91-113 |
| AD-1331213.1 | 92-114 |
| AD-1331329.1 | 186-208 |
| AD-1331240.1 | 310-332 |
| AD-1331262.1 | 551-573 |
| AD-1331264.1 | 553-575 |
| AD-1331265.1 | 554-576 |
| AD-1331266.1 | 555-577 |

TABLE 7

Unmodified Sense and Antisense Strand Sequences of ANGPTL3 dsRNA Agents

| Duplex Name | Sense Sequence 5' to 3' | SEQ ID NO: | Range in NM_014495.3 | Antisense Sequence 5' to 3' | SEQ ID NO: | Range in NM_014495.3 |
|---|---|---|---|---|---|---|
| AD-1331203.3 | UGUUCACAAUUAAGCUCCUUU | 35 | 82-102 | AAAGGAGCUUAAUUGUGAACAUU | 144 | 80-102 |
| AD-1331206.3 | CACAAUUAAGCUCCUUCUUUU | 39 | 86-106 | AAAAGAAGGAGCUUAAUUGUGAA | 148 | 84-106 |
| AD-1331209.3 | AAUUAAGCUCCUUCUUUUUAU | 42 | 89-109 | AUAAAAAGAAGGAGCUUAAUUGU | 151 | 87-109 |
| AD-1331212.3 | AAGCUCCUUCUUUUUAUUGUU | 46 | 93-113 | AACAAUAAAAAGAAGGAGCUUAA | 155 | 91-113 |
| AD-1331213.3 | AGCUCCUUCUUUUUAUUGUUU | 47 | 61-81 | AAACAAUAAAAAGAAGGAGCUUA | 156 | 59-81 |
| AD-1331240.3 | UUUGAUCAGUCUUUUUAUGAU | 75 | 312-332 | AUCAUAAAAAGACUGAUCAAAUA | 184 | 310-332 |
| AD-1331262.3 | ACCCAGAAGUAACUUCACUUU | 97 | 520-540 | AAAGUGAAGUUACUUCUGGGUGU | 206 | 518-540 |
| AD-1331264.3 | CCAGAAGUAACUUCACUUAAA | 99 | 555-575 | UUUAAGTGAAGUUACUUCUGGGU | 208 | 553-575 |
| AD-1331265.3 | CAGAAGUAACUUCACUUAAAA | 100 | 556-576 | UUUUAAGUGAAGUUACUUCUGGG | 209 | 554-576 |
| AD-1331266.3 | AGAAGUAACUUCACUUAAAAU | 101 | 557-577 | AUUUUAAGUGAAGUUACUUCUGG | 210 | 555-577 |
| AD-1331329.3 | AUUUGCUAUGUUAGACGAUGU | 115 | 155-175 | ACAUCGUCUAACAUAGCAAAUCU | 248 | 153-175 |
| AD-1479370.1 | AAGCUCCUUCUUUUUAUUGUU | 46 | 60-80 | AACAAUAAAAAGAAGGAGCUUAA | 155 | 58-80 |
| AD-1479371.1 | AAGCUCCUUCUUUUUAUUGUU | 46 | 60-80 | AACAAUAAAAAGAAGGAGCUUAA | 155 | 58-80 |
| AD-1479372.1 | AAGCUCCUUCUUUUUAUUGUU | 46 | 60-80 | AACAAUAAAAAGAAGGAGCUUGG | 661 | 58-80 |
| AD-1479373.1 | AAGCUCCUUCUUUUUAUUGUU | 46 | 60-80 | AACAAUAAAAAGAAGGAGCUUGG | 661 | 58-80 |

TABLE 7-continued

Unmodified Sense and Antisense Strand Sequences of ANGPTL3 dsRNA Agents

| Duplex Name | Sense Sequence 5' to 3' | SEQ ID NO: | Range in NM_014495.3 | Antisense Sequence 5' to 3' | SEQ ID NO: | Range in NM_014495.3 |
|---|---|---|---|---|---|---|
| AD-1479374.1 | AAGCUCCUUCUUUUUAUUGUA | 612 | 60-80 | UACAAUAAAAGAAGGAGCUUGG | 662 | 58-80 |
| AD-1479375.1 | AAGCUCCUUCUUUUUAUUGUA | 612 | 60-80 | UACAAUAAAAGAAGGAGCUUGG | 662 | 58-80 |
| AD-1479376.1 | AAGCUCCUUCUUUUUAUUGUU | 46 | 60-80 | AACAAUAAAAGAAGGAGCUUCU | 663 | 58-80 |
| AD-1479377.1 | AAGCUCCUUCUUUUUAUUGUU | 46 | 60-80 | AACAAUAAAAGAAGGAGCUUCU | 663 | 58-80 |
| AD-1479378.1 | GCUCCUUCUUUUUAUUGUU | 613 | 62-80 | AACAAUAAAAGAAGGAGCUU | 664 | 60-80 |
| AD-1479379.1 | GCUCCUUCUUUUUAUUGUU | 613 | 62-80 | AACAAUAAAAGAAGGAGCUU | 664 | 60-80 |
| AD-1479380.1 | AAGCACCUUCUUUUUAUUGUU | 614 | 60-80 | AACAAUAAAAGAAGGUGCUUCU | 665 | 58-80 |
| AD-1479381.1 | AAGGUCCUUCUUUUUAUUGUU | 615 | 60-80 | AACAAUAAAAGAAGGACCUUCU | 666 | 58-80 |
| AD-1479382.1 | AACCUCCUUCUUUUUAUUGUU | 616 | 60-80 | AACAAUAAAAGAAGGAGGUUCU | 667 | 58-80 |
| AD-1479383.1 | AGCUCCUUCUUUUUAUUGUUU | 47 | 61-81 | AAACAAUAAAAGAAGGAGCUUA | 668 | 59-81 |
| AD-1479384.1 | AGCUCCUUCUUUUUAUUGUUU | 47 | 61-81 | AAACAAUAAAAGAAGGAGCUUA | 668 | 59-81 |
| AD-1479385.1 | AGCUCCUUCUUUUUAUUGUUU | 47 | 61-81 | AAACAAUAAAAGAAGGAGCUUG | 669 | 59-81 |
| AD-1479386.1 | AGCUCCUUCUUUUUAUUGUUU | 47 | 61-81 | AAACAAUAAAAGAAGGAGCUUG | 669 | 59-81 |
| AD-1479387.1 | AGCUCCUUCUUUUUAUUGUUA | 617 | 61-81 | UAACAAUAAAAGAAGGAGCUUG | 670 | 59-81 |
| AD-1479388.1 | AGCUCCUUCUUUUUAUUGUUA | 617 | 61-81 | UAACAAUAAAAGAAGGAGCUUG | 670 | 59-81 |
| AD-1479389.1 | AGCUCCUUCUUUUUAUUGUUU | 47 | 61-81 | AAACAAUAAAAGAAGGAGCUCU | 671 | 59-81 |
| AD-1479390.1 | AGCUCCUUCUUUUUAUUGUUU | 47 | 61-81 | AAACAAUAAAAGAAGGAGCUCU | 671 | 59-81 |
| AD-1479391.1 | CUCCUUCUUUUUAUUGUUU | 618 | 63-81 | AAACAAUAAAAGAAGGAGCU | 672 | 61-81 |
| AD-1479392.1 | CUCCUUCUUUUUAUUGUUU | 618 | 63-81 | AAACAAUAAAAGAAGGAGCU | 672 | 61-81 |
| AD-1479393.1 | AGCUGCUUCUUUUUAUUGUUU | 619 | 61-81 | AAACAAUAAAAGAAGCAGCUCU | 673 | 59-81 |
| AD-1479394.1 | AGCACCUUCUUUUUAUUGUUU | 620 | 61-81 | AAACAAUAAAAGAAGGUGCUCU | 674 | 59-81 |
| AD-1479395.1 | AGGUCCUUCUUUUUAUUGUUU | 621 | 61-81 | AAACAAUAAAAGAAGGUCCUCU | 675 | 59-81 |
| AD-1479396.1 | CCAGAAGUAACUUCACUUAAA | 99 | 522-542 | UUUAAGTGAAGUUACUUCUGGGU | 208 | 520-542 |
| AD-1479397.1 | CCAGAAGUAACUUCACUUAAA | 99 | 522-542 | UTUAAGTGAAGUUACUUCUGGGU | 676 | 520-542 |
| AD-1479398.1 | CCAGAAGUAACUUCACUUAAA | 99 | 522-542 | UUUAAGTGAAGTUACUUCUGGGU | 677 | 520-542 |

TABLE 7-continued

Unmodified Sense and Antisense Strand Sequences of ANGPTL3 dsRNA Agents

| Duplex Name | Sense Sequence 5' to 3' | SEQ ID NO: | Range in NM_014495.3 | Antisense Sequence 5' to 3' | SEQ ID NO: | Range in NM_014495.3 |
|---|---|---|---|---|---|---|
| AD-1479399.1 | CCAGAAGUAACUUCACUUAAA | 99 | 522-542 | UUUAAGTGAAGTUACTUCUGGGU | 678 | 520-542 |
| AD-1479400.1 | CCAGAAGUAACUUCACUUAAA | 99 | 522-542 | UTUAAGTGAAGUUACUUCUGGCU | 679 | 520-542 |
| AD-1479401.1 | CCAGAAGUAACUUCACUUAAA | 99 | 522-542 | UUUAAGTGAAGTUACUUCUGGCU | 680 | 520-542 |
| AD-1479402.1 | AGAAGUAACUUCACUUAAA | 622 | 524-542 | UTUAAGTGAAGUUACUUCUGG | 681 | 522-542 |
| AD-1479403.1 | AGAAGUAACUUCACUUAAA | 622 | 524-542 | UUUAAGTGAAGTUACUUCUGG | 682 | 522-542 |
| AD-1479404.1 | CCAGAAGUAACUUCACUUAAA | 99 | 522-542 | UTUAAGTGAAGUUACUUCUGGGU | 683 | 520-542 |
| AD-1479405.1 | AGAAGUAACUUCACUUAAA | 622 | 524-542 | UTUAAGTGAAGUUACUUCUGG | 684 | 522-542 |
| AD-1479406.1 | CCAGAAGUAACUUCACUUAAA | 99 | 522-542 | UUUAAGTGAAGUUACUUCUGGGU | 208 | 520-542 |
| AD-1479407.1 | CCAGAAGUAACUUCACUUAAA | 99 | 522-542 | UUUAAGTGAAGUUACUUCUGGGU | 208 | 520-542 |
| AD-1479408.1 | CCAGAAGUAACUUCACUUAAA | 99 | 522-542 | UTUAAGTGAAGUUACUUCUGGGU | 683 | 520-542 |
| AD-1479409.1 | CCAGAAGUAACUUCACUUAAA | 99 | 522-542 | UTUAAGTGAAGUUACUUCUGGGU | 683 | 520-542 |
| AD-1479410.1 | CCAGAAGUAACUUCACUUAAA | 99 | 522-542 | UTUAAGUGAAGTUACUUCUGGCU | 685 | 520-542 |
| AD-1479411.1 | CCAGAAGUAACUUCACUUAAA | 99 | 522-542 | UTUAAGUGAAGTUACUUCUGGCU | 685 | 520-542 |
| AD-1479412.1 | CCAGUAGUAACUUCACUUAAA | 623 | 522-542 | UUUAAGTGAAGUUACUACUGGGU | 686 | 520-542 |
| AD-1479413.1 | CCACAAGUAACUUCACUUAAA | 624 | 522-542 | UUUAAGTGAAGUUACUUGUGGGU | 687 | 520-542 |
| AD-1479414.1 | CCUGAAGUAACUUCACUUAAA | 625 | 522-542 | UUUAAGUGAAGUUACUUCAGGGU | 688 | 520-542 |
| AD-1479415.1 | UGUUCACAAUUAAGCUCCUUU | 35 | 82-102 | AAAGGAGCUUAAUUGUGAACAUU | 144 | 80-102 |
| AD-1479416.1 | UGUUCACAAUUAAGCUCCUUU | 35 | 49-69 | AAAGGAGCUUAAUUGUGAACAUU | 144 | 47-69 |
| AD-1479417.1 | UGUUCACAAUUAAGCUCCUUU | 35 | 49-69 | AAAGGAGCUUAAUUGUGAACAUU | 144 | 47-69 |
| AD-1479418.1 | UGUUCACAAUUAAGCUCCUUU | 35 | 49-69 | AAAGGAGCUUAAUTGTGAACAUU | 689 | 47-69 |
| AD-1479419.1 | UGUUCACAAUUAAGCUCCUUU | 35 | 49-69 | AAAGGAGCUUAAUTGTGAACACU | 690 | 47-69 |
| AD-1479420.1 | UGUUCACAAUUAAGCUCCUUU | 35 | 82-102 | AAAGGAGCUUAAUUGUGAACAGG | 691 | 80-102 |
| AD-1479421.1 | UGUUCACAAUUAAGCUCCUUU | 35 | 82-102 | AAAGGAGCUUAAUUGUGAACAGG | 691 | 80-102 |
| AD-1479422.1 | UGUUCACAAUUAAGCUCCUUU | 35 | 49-69 | AAAGGAGCUUAAUUGUGAACAGG | 691 | 47-69 |
| AD-1479423.1 | UGUUCACAAUUAAGCUCCUUU | 35 | 82-102 | AAAGGAGCUUAAUUGUGAACG | 692 | 82-102 |

TABLE 7-continued

Unmodified Sense and Antisense Strand Sequences of ANGPTL3 dsRNA Agents

| Duplex Name | Sense Sequence 5' to 3' | SEQ ID NO: | Range in NM_014495.3 | Antisense Sequence 5' to 3' | SEQ ID NO: | Range in NM_014495.3 |
|---|---|---|---|---|---|---|
| AD-1479424.1 | UGUUCACAAUUAAGCUCCUUU | 35 | 82-102 | AAAGGAGCUUAAUUGUGAACG | 692 | 82-102 |
| AD-1479425.1 | UGUUCACAAUUAAGCUCCUUU | 35 | 49-69 | AAAGGAGCUUAAUUGUGAACG | 692 | 49-69 |
| AD-1479426.1 | UGUUGACAAUUAAGCUCCUUU | 626 | 49-69 | AAAGGAGCUUAAUUGUCAACAUU | 693 | 47-69 |
| AD-1479427.1 | UGUACACAAUUAAGCUCCUUU | 627 | 49-69 | AAAGGAGCUUAAUUGUGUACAUU | 694 | 47-69 |
| AD-1479428.1 | UGAUCACAAUUAAGCUCCUUU | 628 | 49-69 | AAAGGAGCUUAAUUGUGAUCAUU | 695 | 47-69 |
| AD-1479429.1 | CACAAUUAAGCUCCUUCUUUU | 39 | 53-73 | AAAAGAAGGAGCUUAAUUGUGAA | 148 | 51-73 |
| AD-1479430.1 | CACAAUUAAGCUCCUUCUUUU | 39 | 53-73 | AAAAGAAGGAGCUUAAUUGUGAA | 696 | 51-73 |
| AD-1479431.1 | CACAAUUAAGCUCCUUCUUUU | 39 | 53-73 | AAAAGAAGGAGCUUAAUUGUGGG | 697 | 51-73 |
| AD-1479432.1 | CACAAUUAAGCUCCUUCUUUA | 629 | 53-73 | UAAAGAAGGAGCUUAAUUGUGGG | 698 | 51-73 |
| AD-1479433.1 | CACAAUUAAGCUCCUUCUUUU | 39 | 53-73 | AAAAGAAGGAGCUUAAUUGUGGG | 699 | 51-73 |
| AD-1479434.1 | CACAAUUAAGCUCCUUCUUUU | 39 | 53-73 | AAAAGAAGGAGCUUAAUUGUGCU | 700 | 51-73 |
| AD-1479435.1 | CACAAUUAAGCUCCUUCUUUA | 629 | 53-73 | UAAAGAAGGAGCUUAAUUGUGCU | 701 | 51-73 |
| AD-1479436.1 | CACAAUUAAGCUCCUUCUUUU | 39 | 53-73 | AAAAGAAGGAGCUUAAUUGUGCU | 702 | 51-73 |
| AD-1479437.1 | CAAUUAAGCUCCUUCUUUU | 630 | 55-73 | AAAAGAAGGAGCUUAAUUGUG | 703 | 53-73 |
| AD-1479438.1 | CAAUUAAGCUCCUUCUUUU | 630 | 55-73 | AAAAGAAGGAGCUUAAUUGUG | 704 | 53-73 |
| AD-1479439.1 | CACAUUUAAGCUCCUUCUUUU | 631 | 53-73 | AAAAGAAGGAGCUUAAAUGUGCU | 705 | 51-73 |
| AD-1479440.1 | CACUAUUAAGCUCCUUCUUUU | 632 | 53-73 | AAAAGAAGGAGCUUAAUAGUGCU | 706 | 51-73 |
| AD-1479441.1 | CAGAAUUAAGCUCCUUCUUUU | 633 | 53-73 | AAAAGAAGGAGCUUAAUUCUGCU | 707 | 51-73 |
| AD-1479442.1 | CACAAUUAAGCUCCUUCUUUU | 39 | 53-73 | AAAAGAAGGAGCUUAAUUGUGCU | 700 | 51-73 |
| AD-1479443.1 | CACAAUUAAGCUCCUUCUUUU | 39 | 53-73 | AAAAGAAGGAGCUUAAUUGUGCU | 700 | 51-73 |
| AD-1479444.1 | CACAAUUAAGCUCCUUCUUUU | 39 | 53-73 | AAAAGAAGGAGCUUAAUUGUGCU | 700 | 51-73 |
| AD-1479445.1 | AAUUAAGCUCCUUCUUUUUAU | 42 | 56-76 | AUAAAAAGAAGGAGCUUAAUUGU | 708 | 54-76 |
| AD-1479446.1 | AAUUAAGCUCCUUCUUUUUAA | 634 | 56-76 | UUAAAAAGAAGGAGCUUAAUUGU | 709 | 54-76 |
| AD-1479447.1 | AAUUAAGCUCCUUCUUUUUAU | 42 | 56-76 | AUAAAAAGAAGGAGCUUAAUUGU | 710 | 54-76 |
| AD-1479448.1 | AAUUAAGCUCCUUCUUUUUAA | 634 | 56-76 | UUAAAAAGAAGGAGCUUAAUUGU | 711 | 54-76 |

TABLE 7-continued

Unmodified Sense and Antisense Strand Sequences of ANGPTL3 dsRNA Agents

| Duplex Name | Sense Sequence 5' to 3' | SEQ ID NO: | Range in NM_014495.3 | Antisense Sequence 5' to 3' | SEQ ID NO: | Range in NM_014495.3 |
|---|---|---|---|---|---|---|
| AD-1479449.1 | AAUUAAGCUCCUUCUUUUUAU | 42 | 56-76 | ATAAAAGAAGGAGCUUAAUUGU | 708 | 54-76 |
| AD-1479450.1 | AAUUAAGCUCCUUCUUUUUAU | 42 | 56-76 | ATAAAAGAAGGAGCUUAAUUGU | 708 | 54-76 |
| AD-1479451.1 | UUAAGCUCCUUCUUUUUAU | 635 | 58-76 | ATAAAAGAAGGAGCUUAAUU | 712 | 56-76 |
| AD-1479452.1 | UUAAGCUCCUUCUUUUUAU | 635 | 58-76 | ATAAAAGAAGGAGCTUAAUU | 713 | 56-76 |
| AD-1479453.1 | UUAAGCUCCUUCUUUUUAU | 635 | 58-76 | ATAAAAGAAGGAGCUUAAUU | 712 | 56-76 |
| AD-1479454.1 | UUAAGCUCCUUCUUUUUAU | 635 | 58-76 | ATAAAAGAAGGAGCTUAAUU | 713 | 56-76 |
| AD-1479455.1 | AAUUUAGCUCCUUCUUUUUAU | 636 | 56-76 | ATAAAAGAAGGAGCUAAAUUGU | 714 | 54-76 |
| AD-1479456.1 | AAUAAAGCUCCUUCUUUUUAU | 637 | 56-76 | ATAAAAGAAGGAGCUUUAUUGU | 715 | 54-76 |
| AD-1479457.1 | AAAUAAGCUCCUUCUUUUUAU | 638 | 56-76 | ATAAAAGAAGGAGCUUAUUUGU | 716 | 54-76 |
| AD-1479458.1 | UUUGAUCAGUCUUUUUAUGAU | 75 | 312-332 | AUCATAAAAGACUGAUCAAAUG | 717 | 310-332 |
| AD-1479459.1 | UUUGAUCAGUCUUUUUAUGAA | 639 | 279-299 | UUCATAAAAGACUGAUCAAAUG | 718 | 277-299 |
| AD-1479460.1 | UUUGAUCAGUCUUUUUAUGAU | 75 | 312-332 | ATCATAAAAGACUGAUCAAAUG | 719 | 310-332 |
| AD-1479461.1 | UUUGAUCAGUCUUUUUAUGAU | 75 | 312-332 | ATCAUAAAAGACUGAUCAAAUG | 720 | 310-332 |
| AD-1479462.1 | UUUGAUCAGUCUUUUUAUGAU | 75 | 312-332 | ATCATAAAAGACUGAUCAAAUG | 719 | 310-332 |
| AD-1479463.1 | UUUGAUCAGUCUUUUUAUGAA | 639 | 279-299 | UTCATAAAAGACUGAUCAAAUG | 721 | 277-299 |
| AD-1479464.1 | UUUGAUCAGUCUUUUUAUGAU | 75 | 312-332 | ATCAUAAAAGACUGAUCAAAUG | 720 | 310-332 |
| AD-1479465.1 | UUUGAUCAGUCUUUUUAUGAU | 75 | 312-332 | ATCAUAAAAGACTGAUCAAAUG | 722 | 310-332 |
| AD-1479466.1 | UUUGAUCAGUCUUUUUAUGAU | 75 | 312-332 | ATCATAAAAGACUGAUCAAAUG | 719 | 310-332 |
| AD-1479467.1 | UUGAUCAGUCUUUUUAUGAU | 640 | 280-299 | ATCAUAAAAGACUGAUCAACU | 723 | 278-299 |
| AD-1479468.1 | UUUGAUCAGUCUUUUUAUGAU | 75 | 279-299 | ATCATAAAAGACUGAUCAAACU | 724 | 277-299 |
| AD-1479469.1 | UUUGAUCAGUCUUUUUAUGAU | 75 | 279-299 | ATCATAAAAGACUGAUCAAACU | 724 | 277-299 |
| AD-1479470.1 | UUUGUUCAGUCUUUUUAUGAU | 641 | 279-299 | ATCATAAAAGACUGAACAAAUG | 725 | 277-299 |
| AD-1479471.1 | UUUCAUCAGUCUUUUUAUGAU | 642 | 279-299 | ATCATAAAAGACUGAUGAAAUG | 726 | 277-299 |
| AD-1479472.1 | UUAGAUCAGUCUUUUUAUGAU | 643 | 279-299 | ATCATAAAAGACUGAUCUAAUG | 727 | 277-299 |
| AD-1479473.1 | UUUGAUCAGUCUUUUUAUGAU | 75 | 279-299 | ATCATAAAAGACUGAUCAAACU | 724 | 277-299 |

TABLE 7-continued

Unmodified Sense and Antisense Strand Sequences of ANGPTL3 dsRNA Agents

| Duplex Name | Sense Sequence 5' to 3' | SEQ ID NO: | Range in NM_014495.3 | Antisense Sequence 5' to 3' | SEQ ID NO: | Range in NM_014495.3 |
|---|---|---|---|---|---|---|
| AD-1479474.1 | CAGAAGUAACUUCACUUAAAA | 100 | 556-576 | UUUUAAGUGAAGUUACUUCUGGG | 728 | 554-576 |
| AD-1479475.1 | CAGAAGUAACUUCACUUAAAA | 100 | 556-576 | UUUUAAGUGAAGUUACUUCUGGG | 728 | 554-576 |
| AD-1479476.1 | CAGAAGUAACUUCACUUAAAA | 100 | 556-576 | UUUUAAGUGAAGUUACUUCUGGG | 728 | 554-576 |
| AD-1479477.1 | CAGAAGUAACUUCACUUAAAA | 100 | 556-576 | UUUUAAGUGAAGUUACUUCUGGG | 729 | 554-576 |
| AD-1479478.1 | GAAGUAACUUCACUUAAAA | 644 | 525-543 | UUUUAAGUGAAGUUACUUCUG | 730 | 523-543 |
| AD-1479479.1 | CAGAAGUAACUUCACUUAAAA | 100 | 523-543 | UUUUAAGUGAAGUUACUUCUGGG | 728 | 521-543 |
| AD-1479480.1 | CAGAAGUAACUUCACUUAAAA | 100 | 523-543 | UUUUAAGUGAAGUUACUUCUGGG | 728 | 521-543 |
| AD-1479481.1 | CAGAAGUAACUUCACUUAAAA | 100 | 523-543 | UUUUAAGUGAAGUUACUUCUGGG | 728 | 521-543 |
| AD-1479482.1 | CAGAAGUAACUUCACUUAAAA | 100 | 523-543 | UUUUAAGUGAAGUUACUUCUGGG | 728 | 521-543 |
| AD-1479483.1 | CAGAAGUAACUUCACUUAAAA | 100 | 523-543 | UUUUAAGUGAAGUUACUUCUGGG | 728 | 521-543 |
| AD-1479484.1 | CAGAAGUAACUUCACUUAAAA | 100 | 556-576 | UUUUAAGUGAAGUUACUUCUGGG | 728 | 554-576 |
| AD-1479485.1 | CAGAAGUAACUUCACUUAAAA | 100 | 556-576 | UUUUAAGUGAAGUUACUUCUGGG | 728 | 554-576 |
| AD-1479486.1 | CAGAAGUAACUUCACUUAAAA | 100 | 556-576 | UUUUAAGUGAAGUUACUUCUGGG | 728 | 554-576 |
| AD-1479487.1 | CAGAAGUAACUUCACUUAAAA | 100 | 556-576 | UUUUAAGUGAAGUUACUUCUGGG | 728 | 554-576 |
| AD-1479488.1 | CAGAAGUAACUUCACUUAAAA | 100 | 523-543 | UUUUAAGUGAAGUUACUUCUGGG | 728 | 521-543 |
| AD-1479489.1 | ACCCAGAAGUAACUUCACUUU | 97 | 520-540 | AAAGTGAAGUUACUUCUGGGUGU | 731 | 518-540 |
| AD-1479490.1 | ACCCAGAAGUAACUUCACUUU | 97 | 520-540 | AAAGTGAAGUUACUUCUGGGUGU | 731 | 518-540 |
| AD-1479491.1 | ACCCAGAAGUAACUUCACUUA | 645 | 520-540 | UAAGTGAAGUUACUUCUGGGUGU | 732 | 518-540 |
| AD-1479492.1 | ACCCAGAAGUAACUUCACUUA | 645 | 520-540 | UAAGTGAAGUUACUUCUGGGUGU | 732 | 518-540 |
| AD-1479493.1 | ACCCAGAAGUAACUUUACUUU | 646 | 520-540 | AAAGTAAAGUUACUUCUGGGUGU | 733 | 518-540 |
| AD-1479494.1 | ACCCAGAAGUAACUUCACUUU | 97 | 520-540 | AAAGTGAAGUUACUUCUGGGUGU | 731 | 518-540 |
| AD-1479495.1 | ACCCAGAAGUAACUUCACUUU | 97 | 520-540 | AAAGTGAAGUUACUUCUGGGUGU | 731 | 518-540 |
| AD-1479496.1 | ACCCAGAAGUAACUUCACUUU | 97 | 520-540 | AAAGTGAAGUUACUUCUGGGUCU | 734 | 518-540 |
| AD-1479497.1 | ACCCAGAAGUAACUUCACUUU | 97 | 520-540 | AAAGTGAAGUUACUUCUGGGUCU | 734 | 518-540 |
| AD-1479498.1 | ACCCAGAAGUAACUUCACUUU | 97 | 520-540 | AAAGTGAAGUUACUUCUGGGUCU | 734 | 518-540 |

TABLE 7-continued

Unmodified Sense and Antisense Strand Sequences of ANGPTL3 dsRNA Agents

| Duplex Name | Sense Sequence 5' to 3' | SEQ ID NO: | Range in NM_014495.3 | Antisense Sequence 5' to 3' | SEQ ID NO: | Range in NM_014495.3 |
|---|---|---|---|---|---|---|
| AD-1479499.1 | ACCCAGAAGUAACUUCACUUU | 97 | 520-540 | AAAGTGAAGUUACUUCUGGGUCU | 734 | 518-540 |
| AD-1479500.1 | CCAGAAGUAACUUCACUUU | 647 | 522-540 | AAAGTGAAGUUACUUCUGGGU | 735 | 520-540 |
| AD-1479501.1 | CCAGAAGUAACUUCACUUU | 647 | 522-540 | AAAGTGAAGUUACUUCUGGGU | 735 | 520-540 |
| AD-1479502.1 | CCAGAAGUAACUUCACUUU | 647 | 522-540 | AAAGTGAAGUUACUUCUGGGU | 735 | 520-540 |
| AD-1479503.1 | CCAGAAGUAACUUCACUUU | 647 | 522-540 | AAAGTGAAGUUACUUCUGGGU | 735 | 520-540 |
| AD-1479504.1 | ACCCUGAAGUAACUUCACUUU | 648 | 520-540 | AAAGTGAAGUUACUUCAGGGUGU | 736 | 518-540 |
| AD-1479505.1 | ACCGAGAAGUAACUUCACUUU | 649 | 520-540 | AAAGTGAAGUUACUUCUCGGUGU | 737 | 518-540 |
| AD-1479506.1 | ACGCAGAAGUAACUUCACUUU | 650 | 520-540 | AAAGTGAAGUUACUUCUGCGUGU | 738 | 518-540 |
| AD-1479507.1 | ACCCAGAAGUAACUUCACUUU | 97 | 520-540 | AAAGTGAAGUUACUUCUGGGUGU | 731 | 518-540 |
| AD-1479508.1 | ACCCAGAAGUAACUUCACUUU | 97 | 520-540 | AAAGTGAAGUUACUUCUGGGUGU | 731 | 518-540 |
| AD-1479509.1 | AGAAGUAACUUCACUUAAAAU | 101 | 524-544 | AUUUTAAGUGAAGUUACUUCUGG | 739 | 522-544 |
| AD-1479510.1 | AGAAGUAACUUCACUUAAAAU | 101 | 524-544 | AUUUTAAGUGAAGUUACUUCUGG | 739 | 522-544 |
| AD-1479511.1 | AGAAGUAACUUCACUUAAAAU | 101 | 524-544 | AUUUTAAGUGAAGUUACUUCUGG | 739 | 522-544 |
| AD-1479512.1 | AGAAGUAACUUCACUUAAAAU | 101 | 524-544 | AUUUTAAGUGAAGUUACUUCUGG | 739 | 522-544 |
| AD-1479513.1 | AGAAGUAACUUCACUUAAAAA | 651 | 524-544 | UUUUTAAGUGAAGUUACUUCUGG | 740 | 522-544 |
| AD-1479514.1 | AGAAGUAACUUCACUUAAAAA | 651 | 524-544 | UUUUTAAGUGAAGUUACUUCUGG | 740 | 522-544 |
| AD-1479515.1 | AGAAGUAACUUCACUUAAAAU | 101 | 524-544 | AUUUTAAGUGAAGUUACUUCUGG | 739 | 522-544 |
| AD-1479516.1 | AGAAGUAACUUCACUUAAAAU | 101 | 524-544 | AUUUTAAGUGAAGUUACUUCUGG | 739 | 522-544 |
| AD-1479517.1 | AGAAGUAACUUCACUUAAAAU | 101 | 524-544 | ATUUTAAGUGAAGUUACUUCUGG | 741 | 522-544 |
| AD-1479518.1 | AGAAGUAACUUCACUUAAAAU | 101 | 524-544 | ATUUTAAGUGAAGUUACUUCUGG | 741 | 522-544 |
| AD-1479519.1 | AGAAGUAACUUCACUUAAAAU | 101 | 524-544 | ATUUTAAGUGAAGUUACUUCUGG | 741 | 522-544 |
| AD-1479520.1 | AGAAGUAACUUCACUUAAAAU | 101 | 524-544 | ATUUTAAGUGAAGUUACUUCUGG | 741 | 522-544 |
| AD-1479521.1 | AGAAGUAACUUCACUUAAAAU | 101 | 524-544 | ATUUTAAGUGAAGUUACUUCUCU | 742 | 522-544 |
| AD-1479522.1 | AGAAGUAACUUCACUUAAAAU | 101 | 524-544 | ATUUTAAGUGAAGUUACUUCUCU | 742 | 522-544 |
| AD-1479523.1 | AAGUAACUUCACUUAAAAU | 652 | 526-544 | ATUUTAAGUGAAGUUACUUCU | 743 | 524-544 |

TABLE 7-continued

Unmodified Sense and Antisense Strand Sequences of ANGPTL3 dsRNA Agents

| Duplex Name | Sense Sequence 5' to 3' | SEQ ID NO: | Range in NM_014495.3 | Antisense Sequence 5' to 3' | SEQ ID NO: | Range in NM_014495.3 |
|---|---|---|---|---|---|---|
| AD-1479524.1 | AAGUAACUUCACUUAAAAU | 652 | 526-544 | AUUUAAGUGAAGUUACUUCU | 743 | 524-544 |
| AD-1479525.1 | AGAACUAACUUCACUUAAAU | 653 | 524-544 | AUUUAAGUGAAGUUAGUUCUGG | 744 | 522-544 |
| AD-1479526.1 | AGAUGUAACUUCACUUAAAU | 654 | 524-544 | AUUUAAGUGAAGUUACAUCUGG | 745 | 522-544 |
| AD-1479527.1 | AGUAGUAACUUCACUUAAAU | 655 | 524-544 | AUUUAAGUGAAGUUACUACUGG | 746 | 522-544 |
| AD-1479528.1 | AUUUGCUAUGUUAGACGAUGU | 115 | 155-175 | ACAUCGUCUAACAUAGCAAAUCU | 224 | 153-175 |
| AD-1479529.1 | AUUUGCUAUGUUAGACGAUGU | 115 | 155-175 | ACAUCGUCUAACAUAGCAAAUCU | 747 | 153-175 |
| AD-1479530.1 | AUUUGCUAUGUUAGACGAUGA | 656 | 155-175 | UCAUCGUCUAACAUAGCAAAUCU | 748 | 153-175 |
| AD-1479531.1 | AUUUGCUAUGUUAGACGAUGA | 656 | 155-175 | UCAUCGUCUAACAUAGCAAAUCU | 749 | 153-175 |
| AD-1479532.1 | AUUUGCUAUGUUAGACGAUGA | 656 | 155-175 | UCAUCGUCUAACAUAGCAAAUCU | 748 | 153-175 |
| AD-1479533.1 | AUUUGCUAUGUUAGACGAUGA | 656 | 155-175 | UCAUCGUCUAACAUAGCAAAUCU | 749 | 153-175 |
| AD-1479534.1 | UUGCUAUGUUAGACGAUGU | 657 | 157-175 | ACAUCGUCUAACAUAGCAAGU | 750 | 155-175 |
| AD-1479535.1 | UUGCUAUGUUAGACGAUGU | 657 | 157-175 | ACAUCGUCUAACAUAGCAAGU | 751 | 155-175 |
| AD-1479536.1 | AUUUCCUAUGUUAGACGAUGU | 658 | 155-175 | ACAUCGUCUAACAUAGGAAAUCU | 752 | 153-175 |
| AD-1479537.1 | AUUAGCUAUGUUAGACGAUGU | 659 | 155-175 | ACAUCGUCUAACAUAGCUAAUCU | 753 | 153-175 |
| AD-1479538.1 | AUAUGCUAUGUUAGACGAUGU | 660 | 155-175 | ACAUCGUCUAACAUAGCAUAUCU | 754 | 153-175 |

TABLE 8

Modified Sense and Antisense Strand Sequences of ANGPTL3 dsRNA Agents

| Duplex Name | Sense Sequence 5' to 3' | SEQ ID NO: | Antisense Sequence 5' to 3' | SEQ ID NO: | mRNA Target Sequence | SEQ ID NO: |
|---|---|---|---|---|---|---|
| AD-1331203.3 | usgsuucaCfaAfUfUfaagcuccuuuL96 | 270 | asAfsagdGa(G2p)cuuaauUfgUfgaacasusu | 378 | AAUGUUCACAAUUAAGCUCCUUC | 509 |
| AD-1331206.3 | csascaauUfaAfGfCfuccuucuuuL96 | 274 | asAfsaagAfaggagcuUfaAfuuugsasa | 382 | UUCACAAUUAAGCUCCUUCUUUU | 513 |
| AD-1331209.3 | asasuuaaGfcUfCfCfuucuuuuauL96 | 277 | asUfsaaaAfagaaggaGfcUfuaauusgsu | 385 | ACAAUUAAGCUCCUUCUUUUAU | 516 |
| AD-1331212.3 | asasgcucCfuUfCfUfuuuuauuguuL96 | 25 | asAfscaaUfaaaaagaAfgGfagcuusasa | 22 | UUAAGCUCCUUCUUUUAUUGUU | 520 |
| AD-1331213.3 | asgscuccUfuCfUfUfuuuauuguuL96 | 281 | asAfsacaAfuaaaaagAfaGfgagcususa | 24 | UAAGCUCCUUCUUUUAUUGUUC | 521 |
| AD-1331240.3 | ususugauCfaGfUfCfuuuuuaugauL96 | 309 | asUfscauAfaaaagacUfgAfucaaasusa | 416 | UAUUUGAUCAGUCUUUUUAUGAU | 549 |

TABLE 8-continued

Modified Sense and Antisense Strand Sequences of ANGPTL3 dsRNA Agents

| Duplex Name | Sense Sequence 5' to 3' | SEQ ID NO: | Antisense Sequence 5' to 3' | SEQ ID NO: | mRNA Target Sequence | SEQ ID NO: |
|---|---|---|---|---|---|---|
| AD-1331262.3 | ascsccagAfaGfUfAfacuucacuuuL96 | 331 | asAfsaguGfaaguuacUfuCfuggg usgsu | 438 | ACACCCAGAAGUAACUUC ACUUA | 571 |
| AD-1331264.3 | cscsagaaGfuAfAfCfuucacuuaaaL96 | 333 | usUfsuadAg(Tgn)gaaguuAfcUfu cuggsgsu | 440 | ACCCAGAAGUAACUUCAC UUAAA | 573 |
| AD-1331265.3 | csasgaagUfaAfCfUfucacuuaaaaL96 | 334 | usUfsuudAa(G2p)ugaaguUfaCfu ucugsgsg | 441 | CCCAGAAGUAACUUCACU UAAAA | 574 |
| AD-1331266.3 | asgsaaguAfaCfUfUfcacuuaaaauL96 | 335 | asUfsuuuAfagugaagUfuAfcuucu sgsg | 442 | CCAGAAGUAACUUCACUU AAAAC | 575 |
| AD-1331329.3 | asusuugcuaUfGfUfuagacgauguL96 | 349 | asdCsaudCgdTcuaadCadTadGcaa auscsu | 480 | AGAUUUGCUAUGUUAGAC GAUGU | 589 |
| AD-1479370.1 | asasgcuccuUfCfUfuuuuauuguuL96 | 20 | asdAscadAudAaaaadGaAfggagcu usasa | 825 | UUAAGCUCCUUCUUUUUA UUGUU | 520 |
| AD-1479371.1 | asasgcuccuUfCfUfuuuuauuguuL96 | 20 | asdAscadAudAaaaadGadAgdGagc uusasa | 826 | UUAAGCUCCUUCUUUUUA UUGUU | 520 |
| AD-1479372.1 | asasgcuccuUfCfUfuuuuauuguuL96 | 20 | asdAscadAudAaaaadGaAfggagcu usgsg | 19 | UUAAGCUCCUUCUUUUUA UUGUU | 520 |
| AD-1479373.1 | asasgcuccuUfCfUfuuuuauuguuL96 | 20 | asdAscadAudAaaaadGadAgdGagc uusgsg | 827 | UUAAGCUCCUUCUUUUUA UUGUU | 520 |
| AD-1479374.1 | asasgcuccuUfCfUfuuuuauuguaL96 | 755 | usdAscadAudAaaaadGaAfggagcu usgsg | 828 | UUAAGCUCCUUCUUUUUA UUGUU | 520 |
| AD-1479375.1 | asasgcuccuUfCfUfuuuuauuguaL96 | 755 | usdAscadAudAaaaadGadAgdGagc uusgsg | 829 | UUAAGCUCCUUCUUUUUA UUGUU | 520 |
| AD-1479376.1 | asasgcuccuUfCfUfuuuuauuguuL96 | 20 | asdAscadAudAaaaadGaAfggagcu uscsu | 830 | UUAAGCUCCUUCUUUUUA UUGUU | 520 |
| AD-1479377.1 | asasgcuccuUfCfUfuuuuauuguuL96 | 20 | asdAscadAudAaaaadGadAgdGagc uuscsu | 831 | UUAAGCUCCUUCUUUUUA UUGUU | 520 |
| AD-1479378.1 | gscsuccuUfCfUfuuuuauuguuL96 | 756 | asdAscadAudAaaaadGaAfggagcs usu | 832 | AAGCUCCUUCUUUUUAUU GUU | 977 |
| AD-1479379.1 | gscsuccuUfCfUfuuuuauuguuL96 | 756 | asdAscadAudAaaaadGadAgdGagc susu | 833 | AAGCUCCUUCUUUUUAUU GUU | 977 |
| AD-1479380.1 | asasgcaccuUfCfUfuuuuauuguuL96 | 757 | asdAscadAudAaaaadGaAfggugcu uscsu | 834 | UUAAGCUCCUUCUUUUUA UUGUU | 520 |
| AD-1479381.1 | asasgguccuUfCfUfuuuuauuguuL96 | 758 | asdAscadAudAaaaadGaAfggaccu uscsu | 835 | UUAAGCUCCUUCUUUUUA UUGUU | 520 |
| AD-1479382.1 | asasccuccuUfCfUfuuuuauuguuL96 | 759 | asdAscadAudAaaaadGaAfggaggu uscsu | 836 | UUAAGCUCCUUCUUUUUA UUGUU | 520 |
| AD-1479383.1 | asgscuccuuCfUfUfuuuauuguuuL96 | 760 | asdAsacdAadTaaaadAgAfaggagc ususa | 837 | UAAGCUCCUUCUUUUUAU UGUUC | 521 |
| AD-1479384.1 | asgscuccuuCfUfUfuuuauuguuuL96 | 760 | asdAsacdAadTaaaadAgdAadGgag cususa | 838 | UAAGCUCCUUCUUUUUAU UGUUC | 521 |
| AD-1479385.1 | asgscuccuuCfUfUfuuuauuguuuL96 | 760 | asdAsacdAadTaaaadAgAfaggagc ususg | 839 | UAAGCUCCUUCUUUUUAU UGUUC | 521 |
| AD-1479386.1 | asgscuccuuCfUfUfuuuauuguuuL96 | 760 | asdAsacdAadTaaaadAgdAadGgag cususg | 840 | UAAGCUCCUUCUUUUUAU UGUUC | 521 |
| AD-1479387.1 | asgscuccuuCfUfUfuuuauuguuaL96 | 761 | usdAsacdAadTaaaadAgAfaggagc ususg | 841 | UAAGCUCCUUCUUUUUAU UGUUC | 521 |
| AD-1479388.1 | asgscuccuuCfUfUfuuuauuguuaL96 | 761 | usdAsacdAadTaaaadAgdAadGgag cususg | 842 | UAAGCUCCUUCUUUUUAU UGUUC | 521 |
| AD-1479389.1 | asgscuccuuCfUfUfuuuauuguuuL96 | 760 | asdAsacdAadTaaaadAgAfaggagc uscsu | 843 | UAAGCUCCUUCUUUUUAU UGUUC | 521 |

TABLE 8-continued

Modified Sense and Antisense Strand Sequences of ANGPTL3 dsRNA Agents

| Duplex Name | Sense Sequence 5' to 3' | SEQ ID NO: | Antisense Sequence 5' to 3' | SEQ ID NO: | mRNA Target Sequence | SEQ ID NO: |
|---|---|---|---|---|---|---|
| AD-1479390.1 | asgscuccuuCfUfUfuuuauuguuuL96 | 760 | asdAsacdAadTaaaadAgdAadGgagcuscsu | 844 | UAAGCUCCUUCUUUUUAUUGUUC | 521 |
| AD-1479391.1 | csusccuuCfUfUfuuuauuguuuL96 | 762 | asdAsacdAadTaaaadAgAfaggagscsu | 845 | AGCUCCUUCUUUUUAUUGUUC | 978 |
| AD-1479392.1 | csusccuuCfUfUfuuuauuguuuL96 | 762 | asdAsacdAadTaaaadAgdAadGgagscsu | 846 | AGCUCCUUCUUUUUAUUGUUC | 978 |
| AD-1479393.1 | asgscugcuuCfUfUfuuuauuguuuL96 | 763 | asdAsacdAadTaaaadAgAfagcagcuscsu | 847 | UAAGCUCCUUCUUUUUAUUGUUC | 521 |
| AD-1479394.1 | asgscaccuuCfUfUfuuuauuguuuL96 | 764 | asdAsacdAadTaaaadAgAfaggugcuscsu | 848 | UAAGCUCCUUCUUUUUAUUGUUC | 521 |
| AD-1479395.1 | asgsguccuuCfUfUfuuuauuguuuL96 | 765 | asdAsacdAadTaaaadAgAfagguccuscsu | 849 | UAAGCUCCUUCUUUUUAUUGUUC | 521 |
| AD-1479396.1 | cscsagaaguAfAfCfuucacuuaaaL96 | 766 | usUfsuadAg(Tgn)gaaguuAfcUfucuggsgsu | 440 | ACCCAGAAGUAACUUCACUUAAA | 573 |
| AD-1479397.1 | cscsagaaguAfAfCfuucacuuaaaL96 | 766 | usdTsuadAg(Tgn)gaaguuAfcUfucuggsgsu | 850 | ACCCAGAAGUAACUUCACUUAAA | 573 |
| AD-1479398.1 | cscsagaaguAfAfCfuucacuuaaaL96 | 766 | usUfsuadAg(Tgn)gaagdTuAfcuucuggsgsu | 851 | ACCCAGAAGUAACUUCACUUAAA | 573 |
| AD-1479399.1 | cscsagaaguAfAfCfuucacuuaaaL96 | 766 | usUfsuadAg(Tgn)gaagdTudAcdTucuggsgsu | 852 | ACCCAGAAGUAACUUCACUUAAA | 573 |
| AD-1479400.1 | cscsagaaguAfAfCfuucacuuaaaL96 | 766 | usdTsuadAg(Tgn)gaaguuAfcUfucuggscsu | 853 | ACCCAGAAGUAACUUCACUUAAA | 573 |
| AD-1479401.1 | cscsagaaguAfAfCfuucacuuaaaL96 | 766 | usUfsuadAg(Tgn)gaagdTuAfcuucuggscsu | 854 | ACCCAGAAGUAACUUCACUUAAA | 573 |
| AD-1479402.1 | asgsaaguAfAfCfuucacuuaaaL96 | 767 | usdTsuadAg(Tgn)gaaguuAfcUfucusgsg | 855 | CCAGAAGUAACUUCACUUAAA | 979 |
| AD-1479403.1 | asgsaaguAfAfCfuucacuuaaaL96 | 767 | usUfsuadAg(Tgn)gaagdTuAfcuucusgsg | 856 | CCAGAAGUAACUUCACUUAAA | 979 |
| AD-1479404.1 | cscsagaaguAfAfCfuucacuuaaaL96 | 766 | usdTsuadAg(Tgn)gaagdTuAfcuucuggsgsu | 857 | ACCCAGAAGUAACUUCACUUAAA | 573 |
| AD-1479405.1 | asgsaaguAfAfCfuucacuuaaaL96 | 767 | usdTsuadAg(Tgn)gaagdTuAfcuucusgsg | 858 | CCAGAAGUAACUUCACUUAAA | 979 |
| AD-1479406.1 | cscsagaagudAaCfuucacuuaaaL96 | 768 | usUfsuadAg(Tgn)gaaguuAfcUfucuggsgsu | 440 | ACCCAGAAGUAACUUCACUUAAA | 573 |
| AD-1479407.1 | cscsagaagudAaCfUfucacuuaaaL96 | 769 | usUfsuadAg(Tgn)gaaguuAfcUfucuggsgsu | 440 | ACCCAGAAGUAACUUCACUUAAA | 573 |
| AD-1479408.1 | cscsagaagudAaCfuucacuuaaaL96 | 768 | usdTsuadAg(Tgn)gaagdTuAfcuucuggsgsu | 857 | ACCCAGAAGUAACUUCACUUAAA | 573 |
| AD-1479409.1 | cscsagaagudAaCfUfucacuuaaaL96 | 769 | usdTsuadAg(Tgn)gaagdTuAfcuucuggsgsu | 857 | ACCCAGAAGUAACUUCACUUAAA | 573 |
| AD-1479410.1 | cscsagaagudAaCfuucacuuaaaL96 | 768 | usdTsuadAg(U2p)gaagdTuAfcuucuggscsu | 859 | ACCCAGAAGUAACUUCACUUAAA | 573 |
| AD-1479411.1 | cscsagaagudAaCfUfucacuuaaaL96 | 769 | usdTsuadAg(U2p)gaagdTuAfcuucuggscsu | 859 | ACCCAGAAGUAACUUCACUUAAA | 573 |
| AD-1479412.1 | cscsaguaguAfAfCfuucacuuaaaL96 | 770 | usUfsuadAg(Tgn)gaaguuAfcUfacuggsgsu | 860 | ACCCAGAAGUAACUUCACUUAAA | 573 |
| AD-1479413.1 | cscsacaaguAfAfCfuucacuuaaaL96 | 771 | usUfsuadAg(Tgn)gaaguuAfcUfuguggsgsu | 861 | ACCCAGAAGUAACUUCACUUAAA | 573 |
| AD-1479414.1 | cscsugaaguAfAfCfuucacuuaaaL96 | 772 | usUfsuadAg(Tgn)gaaguuAfcUfucaggsgsu | 862 | ACCCAGAAGUAACUUCACUUAAA | 573 |

TABLE 8-continued

Modified Sense and Antisense Strand Sequences of ANGPTL3 dsRNA Agents

| Duplex Name | Sense Sequence 5' to 3' | SEQ ID NO: | Antisense Sequence 5' to 3' | SEQ ID NO: | mRNA Target Sequence | SEQ ID NO: |
| --- | --- | --- | --- | --- | --- | --- |
| AD-1479415.1 | usgsuucaCfaAfUfUfaagcuccuuuL96 | 270 | asdAsagdGa(G2p)cuuaauUfgUfgaacasusu | 863 | AAUGUUCACAAUUAAGCUCCUUC | 509 |
| AD-1479416.1 | usgsuucacaAfUfUfaagcuccuuuL96 | 773 | asdAsagdGa(G2p)cuuadAuUfgugaacasusu | 864 | AAUGUUCACAAUUAAGCUCCUUC | 509 |
| AD-1479417.1 | usgsuucacaAfUfUfaagcuccuuuL96 | 773 | asdAsagdGa(G2p)cuuadAuUfUfgaacasusu | 865 | AAUGUUCACAAUUAAGCUCCUUC | 509 |
| AD-1479418.1 | usgsuucacaAfUfUfaagcuccuuuL96 | 773 | asdAsagdGa(G2p)cuuadAudTgdTgaacasusu | 866 | AAUGUUCACAAUUAAGCUCCUUC | 509 |
| AD-1479419.1 | usgsuucacaAfUfUfaagcuccuuuL96 | 773 | asdAsagdGa(G2p)cuuadAudTgdTgaacascsu | 867 | AAUGUUCACAAUUAAGCUCCUUC | 509 |
| AD-1479420.1 | usgsuucaCfaAfUfUfaagcuccuuuL96 | 270 | asAfsagdGa(G2p)cuuaauUfgUfgaacasgsg | 868 | AAUGUUCACAAUUAAGCUCCUUC | 509 |
| AD-1479421.1 | usgsuucaCfaAfUfUfaagcuccuuuL96 | 270 | asdAsagdGa(G2p)cuuaauUfgUfgaacasgsg | 869 | AAUGUUCACAAUUAAGCUCCUUC | 509 |
| AD-1479422.1 | usgsuucacaAfUfUfaagcuccuuuL96 | 773 | asdAsagdGa(G2p)cuuadAuUfgugaacasgsg | 870 | AAUGUUCACAAUUAAGCUCCUUC | 509 |
| AD-1479423.1 | usgsuucaCfaAfUfUfaagcuccuuuL96 | 270 | asAfsagdGa(G2p)cuuaauUfgUfgaascsg | 871 | UGUUCACAAUUAAGCUCCUUC | 980 |
| AD-1479424.1 | usgsuucaCfaAfUfUfaagcuccuuuL96 | 270 | asdAsagdGa(G2p)cuuaauUfgUfgaascsg | 872 | UGUUCACAAUUAAGCUCCUUC | 980 |
| AD-1479425.1 | usgsuucacaAfUfUfaagcuccuuuL96 | 773 | asdAsagdGa(G2p)cuuadAuUfgugasacsg | 873 | UGUUCACAAUUAAGCUCCUUC | 980 |
| AD-1479426.1 | usgsuugaCfaAfUfUfaagcuccuuuL96 | 774 | asdAsagdGa(G2p)cuuaauUfgUfcaacasusu | 874 | AAUGUUCACAAUUAAGCUCCUUC | 509 |
| AD-1479427.1 | usgsuacaCfaAfUfUfaagcuccuuuL96 | 775 | asdAsagdGa(G2p)cuuaauUfgUfguacasusu | 875 | AAUGUUCACAAUUAAGCUCCUUC | 509 |
| AD-1479428.1 | usgsaucaCfaAfUfUfaagcuccuuuL96 | 776 | asdAsagdGa(G2p)cuuaauUfgUfuacasusu | 876 | AAUGUUCACAAUUAAGCUCCUUC | 509 |
| AD-1479429.1 | csascaauuaAfGfCfuccuucucuuuuL96 | 777 | asdAsaadGadAggagdCuUfaauugusasa | 877 | UUCACAAUUAAGCUCCUUCUUUU | 513 |
| AD-1479430.1 | csascaauuaAfGfCfuccuucucuuuuL96 | 777 | asdAsaadGadAggagdCudTadAuugsasa | 878 | UUCACAAUUAAGCUCCUUCUUUU | 513 |
| AD-1479431.1 | csascaauuaAfGfCfuccuucucuuuuL96 | 777 | asdAsaadGadAggagdCuUfaauugsgsg | 879 | UUCACAAUUAAGCUCCUUCUUUU | 513 |
| AD-1479432.1 | csascaauuaAfGfCfuccuucucuuuaL96 | 778 | usdAsaadGadAggagdCuUfaauugsgsg | 880 | UUCACAAUUAAGCUCCUUCUUUU | 513 |
| AD-1479433.1 | csascaauuaAfGfCfuccuucucuuuuL96 | 777 | asdAsaadGadAggagdCudTadAuugsgsg | 881 | UUCACAAUUAAGCUCCUUCUUUU | 513 |
| AD-1479434.1 | csascaauuaAfGfCfuccuucucuuuuL96 | 777 | asdAsaadGadAggagdCuUfaauugscsu | 882 | UUCACAAUUAAGCUCCUUCUUUU | 513 |
| AD-1479435.1 | csascaauuaAfGfCfuccuucucuuuaL96 | 778 | usdAsaadGadAggagdCuUfaauugscsu | 883 | UUCACAAUUAAGCUCCUUCUUUU | 513 |
| AD-1479436.1 | csascaauuaAfGfCfuccuucucuuuuL96 | 777 | asdAsaadGadAggagdCudTadAuugscsu | 884 | UUCACAAUUAAGCUCCUUCUUUU | 513 |
| AD-1479437.1 | csasauuaAfGfCfuccuucuuuuL96 | 779 | asdAsaadGadAggagdCuUfaauugsusg | 885 | CACAAUUAAGCUCCUUCUUUU | 981 |
| AD-1479438.1 | csasauuaAfGfCfuccuucuuuuL96 | 779 | asdAsaadGadAggagdCudTadAuugsusg | 886 | CACAAUUAAGCUCCUUCUUUU | 981 |
| AD-1479439.1 | csascauuaAfGfCfuccuucuuuuL96 | 780 | asdAsaadGadAggagdCuUfaauugscsu | 887 | UUCACAAUUAAGCUCCUUCUUUU | 513 |

TABLE 8-continued

Modified Sense and Antisense Strand Sequences of ANGPTL3 dsRNA Agents

| Duplex Name | Sense Sequence 5' to 3' | SEQ ID NO: | Antisense Sequence 5' to 3' | SEQ ID NO: | mRNA Target Sequence | SEQ ID NO: |
|---|---|---|---|---|---|---|
| AD-1479440.1 | csascuauuaAfGfCfuccuucuuuuL96 | 781 | asdAsaadGadAggagdCuUfaauagugscsu | 888 | UUCACAAUUAAGCUCCUUCUUUU | 513 |
| AD-1479441.1 | csasgaauuaAfGfCfuccuucuuuuL96 | 782 | asdAsaadGadAggagdCuUfaauucugscsu | 889 | UUCACAAUUAAGCUCCUUCUUUU | 513 |
| AD-1479442.1 | csascaauuadAgCfuccuucuuuuL96 | 783 | asdAsaadGadAggagdCuUfaauugugscsu | 882 | UUCACAAUUAAGCUCCUUCUUUU | 513 |
| AD-1479443.1 | csascaauuadAgCfUfccuucuuuuL96 | 784 | asdAsaadGadAggagdCuUfaauugugscsu | 882 | UUCACAAUUAAGCUCCUUCUUUU | 513 |
| AD-1479444.1 | csascaauuaAfGfCfuccuucuuuuL96 | 777 | asdAsaadGa(A2p)ggagdCuUfaAfuugugscsu | 890 | UUCACAAUUAAGCUCCUUCUUUU | 513 |
| AD-1479445.1 | asasuuaagcUfCfCfuucuuuuauL96 | 785 | asdTsaadAadAgaagdGaGfcuuaauusgsu | 891 | ACAAUUAAGCUCCUUCUUUUAU | 516 |
| AD-1479446.1 | asasuuaagcUfCfCfuucuuuuaaL96 | 786 | usdTsaadAadAgaagdGaGfcuuaauusgsu | 892 | ACAAUUAAGCUCCUUCUUUUAU | 516 |
| AD-1479447.1 | asasuuaagcUfCfCfuucuuuuauL96 | 785 | asdTsaadAadAgaagdGadGcdTuaauusgsu | 893 | ACAAUUAAGCUCCUUCUUUUAU | 516 |
| AD-1479448.1 | asasuuaagcUfCfCfuucuuuuaaL96 | 786 | usdTsaadAadAgaagdGadGcdTuaauusgsu | 894 | ACAAUUAAGCUCCUUCUUUUAU | 516 |
| AD-1479449.1 | asasuuaagcUfCfCfuucuuuuauL96 | 785 | asdTsaadAa(A2p)gaagdGaGfcuuaauusgsu | 895 | ACAAUUAAGCUCCUUCUUUUAU | 516 |
| AD-1479450.1 | asasuuaagcUfCfCfuucuuuuauL96 | 785 | asdTsaadAa(A2p)gaagdGaGfcUfuaauusgsu | 896 | ACAAUUAAGCUCCUUCUUUUAU | 516 |
| AD-1479451.1 | ususaagcUfCfCfuucuuuuauL96 | 787 | asdTsaadAadAgaagdGaGfcuuaasusu | 897 | AAUUAAGCUCCUUCUUUUAU | 982 |
| AD-1479452.1 | ususaagcUfCfCfuucuuuuauL96 | 787 | asdTsaadAadAgaagdGadGcdTuaasusu | 898 | AAUUAAGCUCCUUCUUUUAU | 982 |
| AD-1479453.1 | ususaagcUfCfCfuucuuuuauL96 | 787 | asdTsaadAa(A2p)gaagdGaGfcuuaasusu | 899 | AAUUAAGCUCCUUCUUUUAU | 982 |
| AD-1479454.1 | ususaagcUfCfCfuucuuuuauL96 | 787 | asdTsaadAa(A2p)gaagdGadGcdTuaasusu | 900 | AAUUAAGCUCCUUCUUUUAU | 982 |
| AD-1479455.1 | asasuuuagcUfCfCfuucuuuuauL96 | 788 | asdTsaadAadAgaagdGaGfcuaaausgsu | 901 | ACAAUUAAGCUCCUUCUUUUAU | 516 |
| AD-1479456.1 | asasuaagcUfCfCfuucuuuuauL96 | 789 | asdTsaadAadAgaagdGaGfcuuuausgsu | 902 | ACAAUUAAGCUCCUUCUUUUAU | 516 |
| AD-1479457.1 | asasauaagcUfCfCfuucuuuuauL96 | 790 | asdTsaadAadAgaagdGaGfcuuauusgsu | 903 | ACAAUUAAGCUCCUUCUUUUAU | 516 |
| AD-1479458.1 | ususugauCfaGfUfCfuuuuuaugauL96 | 309 | asUfscadTa(A2p)aaagacUfgAfucaaasusg | 904 | UAUUUGAUCAGUCUUUUAUGAU | 549 |
| AD-1479459.1 | ususugauCfaGfUfCfuuuuuaugaaL96 | 791 | usUfscadTa(A2p)aaagacUfgAfuacaasusg | 905 | UAUUUGAUCAGUCUUUUAUGAU | 549 |
| AD-1479460.1 | ususugauCfaGfUfCfuuuuuaugauL96 | 309 | asdTscadTa(A2p)aaagacUfgAfucaaasusg | 906 | UAUUUGAUCAGUCUUUUAUGAU | 549 |
| AD-1479461.1 | ususugauCfaGfUfCfuuuuuaugauL96 | 309 | asdTscaua(A2p)aaagacUfgdAucaaasusg | 907 | UAUUUGAUCAGUCUUUUAUGAU | 549 |
| AD-1479462.1 | ususugauCfaGfUfCfuuuuuaugauL96 | 309 | asdTscadTa(A2p)aaagdAcUfgAfucaaasusg | 908 | UAUUUGAUCAGUCUUUUAUGAU | 549 |
| AD-1479463.1 | ususugauCfaGfUfCfuuuuuaugaaL96 | 791 | usdTscadTa(A2p)aaagdAcUfgAfucaaasusg | 909 | UAUUUGAUCAGUCUUUUAUGAU | 549 |
| AD-1479464.1 | ususugauCfaGfUfCfuuuuuaugauL96 | 309 | asdTscaua(A2p)aaagdAcUfgdAucaaasusg | 910 | UAUUUGAUCAGUCUUUUAUGAU | 549 |

TABLE 8-continued

Modified Sense and Antisense Strand Sequences of ANGPTL3 dsRNA Agents

| Duplex Name | Sense Sequence 5' to 3' | SEQ ID NO: | Antisense Sequence 5' to 3' | SEQ ID NO: | mRNA Target Sequence | SEQ ID NO: |
|---|---|---|---|---|---|---|
| AD-1479465.1 | ususugauCfaGfUfCfuuuuuaugauL96 | 309 | asdTscaua(A2p)aaagdAcdTgdAucaasusg | 911 | UAUUUGAUCAGUCUUUUUAUGAU | 549 |
| AD-1479466.1 | ususugauCfaGfUfCfuuuuuaugauL96 | 309 | asdTscadTa(A2p)aaagdAcUfgaucaaasusg | 912 | UAUUUGAUCAGUCUUUUUAUGAU | 549 |
| AD-1479467.1 | ususgauCfaGfUfCfuuuuuaugauL96 | 792 | asdTscaua(A2p)aaagdAcUfgaucaascsu | 913 | AUUUGAUCAGUCUUUUUAUGAU | 983 |
| AD-1479468.1 | ususgaucadGuCfUfuuuuaugauL96 | 793 | asdTscadTa(A2p)aaagdAcUfgAfucaaascsu | 914 | UAUUUGAUCAGUCUUUUUAUGAU | 549 |
| AD-1479469.1 | ususgaucagUfCfUfuuuuaugauL96 | 794 | asdTscadTa(A2p)aaagdAcUfgAfucaaascsu | 914 | UAUUUGAUCAGUCUUUUUAUGAU | 549 |
| AD-1479470.1 | ususuguuCfaGfUfCfuuuuuaugauL96 | 795 | asdTscadTa(A2p)aaagdAcUfgAfacaaasusg | 915 | UAUUUGAUCAGUCUUUUUAUGAU | 549 |
| AD-1479471.1 | ususucauCfaGfUfCfuuuuuaugauL96 | 796 | asdTscadTa(A2p)aaagdAcUfgAfugaaasusg | 916 | UAUUUGAUCAGUCUUUUUAUGAU | 549 |
| AD-1479472.1 | ususagauCfaGfUfCfuuuuuaugauL96 | 797 | asdTscadTa(A2p)aaagdAcUfgAfucuaasusg | 917 | UAUUUGAUCAGUCUUUUUAUGAU | 549 |
| AD-1479473.1 | ususugaucaGfUfCfuuuuuaugauL96 | 798 | asdTscadTadAaaagdAcUfgaucaaascsu | 918 | UAUUUGAUCAGUCUUUUUAUGAU | 549 |
| AD-1479474.1 | csasgaagUfaAfCfUfucacuuaaaaL96 | 334 | usdTsuudAa(G2p)ugaaguUfaCfuucugsgsg | 919 | CCCAGAAGUAACUUCACUUAAAA | 574 |
| AD-1479475.1 | csasgaagUfaAfCfUfucacuuaaaaL96 | 334 | usdTsuudAa(G2p)ugaadGuUfaCfuucugsgsg | 920 | CCCAGAAGUAACUUCACUUAAAA | 574 |
| AD-1479476.1 | csasgaagUfaAfCfUfucacuuaaaaL96 | 334 | usdTsuudAa(G2p)ugaadGuUfacuucugsgsg | 921 | CCCAGAAGUAACUUCACUUAAAA | 574 |
| AD-1479477.1 | csasgaagUfaAfCfUfucacuuaaaaL96 | 334 | usdTsuudAa(G2p)ugaadGudTadCuucugsgsg | 922 | CCCAGAAGUAACUUCACUUAAAA | 574 |
| AD-1479478.1 | gsasagUfaAfCfUfucacuuaaaaL96 | 799 | usdTsuudAa(G2p)ugaadGuUfacucsusg | 923 | CAGAAGUAACUUCACUUAAA | 984 |
| AD-1479479.1 | csasgaagUfadAcfUfucacuuaaaaL96 | 800 | usdTsuudAa(G2p)ugaadGuUfacuucugsgsg | 921 | CCCAGAAGUAACUUCACUUAAAA | 574 |
| AD-1479480.1 | csasgaagUfadAcUfucacuuaaaaL96 | 801 | usdTsuudAa(G2p)ugaadGuUfacuucugsgsg | 921 | CCCAGAAGUAACUUCACUUAAAA | 574 |
| AD-1479481.1 | csasgaaguadAcUfucacuuaaaaL96 | 802 | usdTsuudAa(G2p)ugaadGuUfacuucugsgsg | 921 | CCCAGAAGUAACUUCACUUAAAA | 574 |
| AD-1479482.1 | csasgaaguadAcUfUfcacuuaaaaL96 | 803 | usdTsuudAa(G2p)ugaadGuUfacuucugsgsg | 921 | CCCAGAAGUAACUUCACUUAAAA | 574 |
| AD-1479483.1 | csasgaaguaaCfUfUfcacuuaaaaL96 | 804 | usdTsuudAa(G2p)ugaadGuUfacuucugsgsg | 921 | CCCAGAAGUAACUUCACUUAAAA | 574 |
| AD-1479484.1 | csasgaagUfaAfCfUfucacuuaaaaL96 | 334 | usdTsuudAa(G2p)ugaadGu(U2p)aCfuucugsgsg | 924 | CCCAGAAGUAACUUCACUUAAAA | 574 |
| AD-1479485.1 | csasgaagUfaAfCfUfucacuuaaaaL96 | 334 | usdTsuudAa(G2p)ugaadGuUf(A2p)Cfuucugsgsg | 925 | CCCAGAAGUAACUUCACUUAAAA | 574 |
| AD-1479486.1 | csasgaagUfaAfCfUfucacuuaaaaL96 | 334 | usdTsuudAa(G2p)ugaadGuUfa(C2p)uucugsgsg | 926 | CCCAGAAGUAACUUCACUUAAAA | 574 |
| AD-1479487.1 | csasgaagUfaAfCfUfucacuuaaaaL96 | 334 | usdTsuudAa(G2p)ugaadGuUfaCf(U2p)ucugsgsg | 927 | CCCAGAAGUAACUUCACUUAAAA | 574 |
| AD-1479488.1 | csasgaaguaAfCfUfucacuuaaaaL96 | 805 | usdTsuudAadGugaadGuUfacuucugsgsg | 928 | CCCAGAAGUAACUUCACUUAAAA | 574 |
| AD-1479489.1 | ascsccagaaGfUfAfacuucacuuuUL96 | 806 | asAfsagdTg(Agn)aguuacUfuCfuggusgsu | 929 | ACACCCAGAAGUAACUUCACUUA | 571 |

TABLE 8-continued

Modified Sense and Antisense Strand Sequences of ANGPTL3 dsRNA Agents

| Duplex Name | Sense Sequence 5' to 3' | SEQ ID NO: | Antisense Sequence 5' to 3' | SEQ ID NO: | mRNA Target Sequence | SEQ ID NO: |
|---|---|---|---|---|---|---|
| AD-1479490.1 | ascsccagaaGfUfAfacuucacuuuL96 | 806 | asAfsagdTg(A2p)aguuacUfuCfugggusgsu | 930 | ACACCCAGAAGUAACUUCACUUA | 571 |
| AD-1479491.1 | ascsccagaaGfUfAfacuucacuuaL96 | 807 | usAfsagdTg(Agn)aguuacUfuCfugggusgsu | 931 | ACACCCAGAAGUAACUUCACUUA | 571 |
| AD-1479492.1 | ascsccagaaGfUfAfacuucacuuaL96 | 807 | usAfsagdTg(A2p)aguuacUfuCfugggusgsu | 932 | ACACCCAGAAGUAACUUCACUUA | 571 |
| AD-1479493.1 | ascsccagaaGfUfAfacuuuacuuuL96 | 808 | asAfsagdTadAaguuacUfuCfugggusgsu | 933 | ACACCCAGAAGUAACUUCACUUA | 571 |
| AD-1479494.1 | ascsccagaaGfUfAfacuucacuuuL96 | 806 | asdAsagdTg(Agn)aguuacUfuCfugggusgsu | 934 | ACACCCAGAAGUAACUUCACUUA | 571 |
| AD-1479495.1 | ascsccagaaGfUfAfacuucacuuuL96 | 806 | asdAsagdTg(A2p)aguuacUfuCfugggusgsu | 935 | ACACCCAGAAGUAACUUCACUUA | 571 |
| AD-1479496.1 | ascsccagaaGfUfAfacuucacuuuL96 | 806 | asdAsagdTg(Agn)aguuacUfuCfugggguscsu | 936 | ACACCCAGAAGUAACUUCACUUA | 571 |
| AD-1479497.1 | ascsccagaaGfUfAfacuucacuuuL96 | 806 | asdAsagdTg(A2p)aguuacUfuCfugggguscsu | 937 | ACACCCAGAAGUAACUUCACUUA | 571 |
| AD-1479498.1 | ascsccagaaGfUfAfacuucacuuuL96 | 806 | asAfsagdTg(A2p)aguuacUfuCfugggguscsu | 938 | ACACCCAGAAGUAACUUCACUUA | 571 |
| AD-1479499.1 | ascsccagaaGfUfAfacuucacuuuL96 | 806 | asdAsagdTg(A2p)aguudAcUfuCfuggguscsu | 939 | ACACCCAGAAGUAACUUCACUUA | 571 |
| AD-1479500.1 | cscsagaaGfUfAfacuucacuuuL96 | 809 | asdAsagdTg(Agn)aguuacUfuCfuggsgsu | 940 | ACCCAGAAGUAACUUCACUUA | 985 |
| AD-1479501.1 | cscsagaaGfUfAfacuucacuuuL96 | 809 | asdAsagdTg(A2p)aguuacUfuCfuggsgsu | 941 | ACCCAGAAGUAACUUCACUUA | 985 |
| AD-1479502.1 | cscsagaaGfUfAfacuucacuuuL96 | 809 | asAfsagdTg(A2p)aguuacUfuCfuggsgsu | 942 | ACCCAGAAGUAACUUCACUUA | 985 |
| AD-1479503.1 | cscsagaaGfUfAfacuucacuuuL96 | 809 | asdAsagdTg(A2p)aguudAcUfuCfuggsgsu | 943 | ACCCAGAAGUAACUUCACUUA | 985 |
| AD-1479504.1 | ascsccugaaGfUfAfacuucacuuuL96 | 810 | asdAsagdTg(A2p)aguuacUfuCfagggusgsu | 944 | ACACCCAGAAGUAACUUCACUUA | 571 |
| AD-1479505.1 | ascscgagaaGfUfAfacuucacuuuL96 | 811 | asdAsagdTg(A2p)aguuacUfuCfucggusgsu | 945 | ACACCCAGAAGUAACUUCACUUA | 571 |
| AD-1479506.1 | ascsgcagaaGfUfAfacuucacuuuL96 | 812 | asdAsagdTg(A2p)aguuacUfuCfugcgusgsu | 946 | ACACCCAGAAGUAACUUCACUUA | 571 |
| AD-1479507.1 | ascsccagaagUfAfAfcuucacuuuL96 | 813 | asdAsagdTg(Agn)aguuacUfuCfugggusgsu | 934 | ACACCCAGAAGUAACUUCACUUA | 571 |
| AD-1479508.1 | ascsccagaagUfAfAfcuucacuuuL96 | 813 | asdAsagdTg(A2p)aguuacUfuCfugggusgsu | 935 | ACACCCAGAAGUAACUUCACUUA | 571 |
| AD-1479509.1 | asgsaaguaaCfUfUfcacuuaaaauL96 | 814 | asUfsuudTa(Agn)gugaagUfuAfcuucusgsg | 947 | CCAGAAGUAACUUCACUUAAAAC | 575 |
| AD-1479510.1 | asgsaaguaaCfUfUfcacuuaaaauL96 | 814 | asUfsuudTa(A2p)gugaagUfuAfcuucusgsg | 948 | CCAGAAGUAACUUCACUUAAAAC | 575 |
| AD-1479511.1 | asgsaaguaaCfUfUfcacuuaaaauL96 | 814 | asUfsuudTa(Agn)gugadAgUfuAfcuucusgsg | 949 | CCAGAAGUAACUUCACUUAAAAC | 575 |
| AD-1479512.1 | asgsaaguaaCfUfUfcacuuaaaauL96 | 814 | asUfsuudTa(A2p)gugadAgUfuAfcuucusgsg | 950 | CCAGAAGUAACUUCACUUAAAAC | 575 |
| AD-1479513.1 | asgsaaguaaCfUfUfcacuuaaaaaL96 | 815 | usUfsuudTa(Agn)gugadAgUfuAfcuucusgsg | 951 | CCAGAAGUAACUUCACUUAAAAC | 575 |
| AD-1479514.1 | asgsaaguaaCfUfUfcacuuaaaaaL96 | 815 | usUfsuudTa(A2p)gugadAgUfuAfcuucusgsg | 952 | CCAGAAGUAACUUCACUUAAAAC | 575 |

TABLE 8-continued

Modified Sense and Antisense Strand Sequences of ANGPTL3 dsRNA Agents

| Duplex Name | Sense Sequence 5' to 3' | SEQ ID NO: | Antisense Sequence 5' to 3' | SEQ ID NO: | mRNA Target Sequence | SEQ ID NO: |
|---|---|---|---|---|---|---|
| AD-1479515.1 | asgsaaguaaCfUfUfcacuuaaaauL96 | 814 | asUfsuudTa(Agn)gugadAgUfuacuucusgsg | 953 | CCAGAAGUAACUUCACUUAAAAC | 575 |
| AD-1479516.1 | asgsaaguaaCfUfUfcacuuaaaauL96 | 814 | asUfsuudTa(A2p)gugadAgUfuacuucusgsg | 954 | CCAGAAGUAACUUCACUUAAAAC | 575 |
| AD-1479517.1 | asgsaaguaaCfUfUfcacuuaaaauL96 | 814 | asdTsuudTa(Agn)gugadAgUfuAfcuucusgsg | 955 | CCAGAAGUAACUUCACUUAAAAC | 575 |
| AD-1479518.1 | asgsaaguaaCfUfUfcacuuaaaauL96 | 814 | asdTsuudTa(A2p)gugadAgUfuAfcuucusgsg | 956 | CCAGAAGUAACUUCACUUAAAAC | 575 |
| AD-1479519.1 | asgsaaguaaCfUfUfcacuuaaaauL96 | 814 | asdTsuudTa(Agn)gugadAgUfuacuucusgsg | 957 | CCAGAAGUAACUUCACUUAAAAC | 575 |
| AD-1479520.1 | asgsaaguaaCfUfUfcacuuaaaauL96 | 814 | asdTsuudTa(A2p)gugadAgUfuacuucusgsg | 958 | CCAGAAGUAACUUCACUUAAAAC | 575 |
| AD-1479521.1 | asgsaaguaaCfUfUfcacuuaaaauL96 | 814 | asdTsuudTa(A2p)gugadAgUfuAfcuucuscsu | 959 | CCAGAAGUAACUUCACUUAAAAC | 575 |
| AD-1479522.1 | asgsaaguaaCfUfUfcacuuaaaauL96 | 814 | asdTsuudTa(A2p)gugadAgUfuacuucuscsu | 960 | CCAGAAGUAACUUCACUUAAAAC | 575 |
| AD-1479523.1 | asasguaaCfUfUfcacuuaaaauL96 | 816 | asdTsuudTa(A2p)gugadAgUfuAfucuscsu | 961 | AGAAGUAACUUCACUUAAAAC | 986 |
| AD-1479524.1 | asasguaaCfUfUfcacuuaaaauL96 | 816 | asdTsuudTa(A2p)gugadAgUfuacuuscsu | 962 | AGAAGUAACUUCACUUAAAAC | 986 |
| AD-1479525.1 | asgsaacuaaCfUfUfcacuuaaaauL96 | 817 | asUfsuudTa(A2p)gugaagUfuAfguucusgsg | 963 | CCAGAAGUAACUUCACUUAAAAC | 575 |
| AD-1479526.1 | asgsauguaaCfUfUfcacuuaaaauL96 | 818 | asUfsuudTa(A2p)gugaagUfuAfcaucusgsg | 964 | CCAGAAGUAACUUCACUUAAAAC | 575 |
| AD-1479527.1 | asgsuaguaaCfUfUfcacuuaaaauL96 | 819 | asUfsuudTa(A2p)gugaagUfuAfcaucusgsg | 965 | CCAGAAGUAACUUCACUUAAAAC | 575 |
| AD-1479528.1 | asusuugcuaUfGfUfuagacgauguL96 | 349 | asdCsaudCg(Tgn)cuaadCaUfadGaacauscsu | 966 | AGAUUUGCUAUGUUAGACGAUGU | 589 |
| AD-1479529.1 | asusuugcuaUfGfUfuagacgauguL96 | 349 | asdCsaudCg(U2p)cuaadCaUfadGcaaauscsu | 967 | AGAUUUGCUAUGUUAGACGAUGU | 589 |
| AD-1479530.1 | asusuugcuaUfGfUfuagacgaugaL96 | 820 | usdCsaudCg(Tgn)cuaadCaUfadGcaaauscsu | 968 | AGAUUUGCUAUGUUAGACGAUGU | 589 |
| AD-1479531.1 | asusuugcuaUfGfUfuagacgaugaL96 | 820 | usdCsaudCg(U2p)cuaadCaUfadGcaaauscsu | 969 | AGAUUUGCUAUGUUAGACGAUGU | 589 |
| AD-1479532.1 | asusuugcuaUfGfUfuagacgaugaL96 | 820 | usdCsaudCg(Tgn)cuaadCaUfagcaaauscsu | 970 | AGAUUUGCUAUGUUAGACGAUGU | 589 |
| AD-1479533.1 | asusuugcuaUfGfUfuagacgaugaL96 | 820 | usdCsaudCg(U2p)cuaadCaUfagcaaauscsu | 971 | AGAUUUGCUAUGUUAGACGAUGU | 589 |
| AD-1479534.1 | ususgcuaUfGfUfuagacgauguL96 | 821 | asdCsaudCg(Tgn)cuaadCaUfadGacasgsu | 972 | AUUUGCUAUGUUAGACGAUGU | 26 |
| AD-1479535.1 | ususgcuaUfGfUfuagacgauguL96 | 821 | asdCsaudCg(U2p)cuaadCaUfadGcaasgsu | 973 | AUUUGCUAUGUUAGACGAUGU | 26 |
| AD-1479536.1 | asusuuccuaUfGfUfuagacgauguL96 | 822 | asdCsaudCg(U2p)cuaadCaUfadGagaauscsu | 974 | AGAUUUGCUAUGUUAGACGAUGU | 589 |
| AD-1479537.1 | asusuagcuaUfGfUfuagacgauguL96 | 823 | asdCsaudCg(U2p)cuaadCaUfadGcuaauscsu | 975 | AGAUUUGCUAUGUUAGACGAUGU | 589 |
| AD-1479538.1 | asusuaugcuaUfGfUfuagacgauguL96 | 824 | asdCsaudCg(U2p)cuaadCaUfadGcauauscsu | 976 | AGAUUUGCUAUGUUAGACGAUGU | 589 |

TABLE 9

ANGPTL3 Dose Screen in Primary Cynomolgus Hepatocytes (PCH)

| | 10 nM | | 1 nM | | 0.1 nM | |
|---|---|---|---|---|---|---|
| Duplex | % Avg Message Remaining | STDEV | % Avg Message Remaining | STDEV | % Avg Message Remaining | STDEV |
| AD-1331203.3 | 21.83 | 3.88 | 37.26 | 10.35 | 63.40 | 6.85 |
| AD-1331206.3 | 26.97 | 6.93 | 36.84 | 0.72 | 63.76 | 8.49 |
| AD-1331209.3 | 29.11 | 6.54 | 47.11 | 9.54 | 69.87 | 10.35 |
| AD-1331212.3 | 20.51 | 1.87 | 32.34 | 3.79 | 64.22 | 4.01 |
| AD-1331213.3 | 24.52 | 6.06 | 54.62 | 13.41 | 79.48 | 4.89 |
| AD-1331240.3 | 23.28 | 2.48 | 39.36 | 12.24 | 61.69 | 2.10 |
| AD-1331262.3 | 21.78 | 4.54 | 36.65 | 10.43 | 34.32 | 6.45 |
| AD-1331264.3 | 30.25 | 4.78 | 42.15 | 9.57 | 73.71 | 7.94 |
| AD-1331265.3 | 15.48 | 6.76 | 23.56 | 9.61 | 58.07 | 11.35 |
| AD-1331266.3 | 22.04 | 6.40 | 37.66 | 7.86 | 76.54 | 13.10 |
| AD-1331329.3 | 27.51 | 4.89 | 48.91 | 13.92 | 80.66 | 18.31 |
| AD-1479370.1 | 21.73 | 4.33 | 30.33 | 5.56 | 48.74 | 4.38 |
| AD-1479371.1 | 31.70 | 5.00 | 45.03 | 9.50 | 75.21 | 6.98 |
| AD-1479372.1 | 24.67 | 4.69 | 31.62 | 5.49 | 48.74 | 11.67 |
| AD-1479373.1 | 24.70 | 5.31 | 42.70 | 11.47 | 55.73 | 7.91 |
| AD-1479374.1 | 20.99 | 5.74 | 39.52 | 8.56 | 53.59 | 9.84 |
| AD-1479375.1 | 34.71 | 4.39 | 42.32 | 8.36 | 68.22 | 7.34 |
| AD-1479376.1 | 27.40 | 3.28 | 39.83 | 8.85 | 75.37 | 7.01 |
| AD-1479377.1 | 23.02 | 6.24 | 28.41 | 4.55 | 46.53 | 3.65 |
| AD-1479378.1 | 19.86 | 2.91 | 35.90 | 5.17 | 65.17 | 6.57 |
| AD-1479379.1 | 40.95 | 9.09 | 45.69 | 7.59 | 91.98 | 9.04 |
| AD-1479380.1 | 33.08 | 3.69 | 41.27 | 4.32 | 77.14 | 6.74 |
| AD-1479381.1 | 59.79 | 5.80 | 58.68 | 11.10 | 97.26 | 18.01 |
| AD-1479382.1 | 54.83 | 6.34 | 69.58 | 12.85 | 106.90 | 10.18 |
| AD-1479383.1 | 26.82 | 7.80 | 39.42 | 5.78 | 66.74 | 13.93 |
| AD-1479384.1 | 31.41 | 9.09 | 42.81 | 8.93 | 77.27 | 6.47 |
| AD-1479385.1 | 23.53 | 2.60 | 42.30 | 6.40 | 63.42 | 5.36 |
| AD-1479386.1 | 58.87 | 11.25 | 63.77 | 6.47 | 82.82 | 7.42 |
| AD-1479387.1 | 28.69 | 6.25 | 40.57 | 7.31 | 66.99 | 5.01 |
| AD-1479388.1 | 44.77 | 1.46 | 71.86 | 11.05 | 102.85 | 5.40 |
| AD-1479389.1 | 33.00 | 3.97 | 59.97 | 7.53 | 76.18 | 7.92 |
| AD-1479390.1 | 63.21 | 14.55 | 94.18 | 30.48 | 110.96 | 4.78 |
| AD-1479391.1 | 19.40 | 2.17 | 32.29 | 10.49 | 48.57 | 6.14 |
| AD-1479392.1 | 61.28 | 6.41 | 77.43 | 17.86 | 100.18 | 14.53 |
| AD-1479393.1 | 96.38 | 5.44 | 123.77 | 19.35 | 131.27 | 5.92 |
| AD-1479394.1 | 75.77 | 11.27 | 84.31 | 5.24 | 125.94 | 10.43 |
| AD-1479395.1 | 84.00 | 3.40 | 110.51 | 15.20 | 135.40 | 22.27 |
| AD-1479396.1 | 20.02 | 5.37 | 32.81 | 7.36 | 56.85 | 11.34 |
| AD-1479397.1 | 13.38 | 2.73 | 26.07 | 1.29 | 42.37 | 9.09 |
| AD-1479398.1 | 18.15 | 3.78 | 37.73 | 7.00 | 51.52 | 7.54 |
| AD-1479399.1 | 26.26 | 3.82 | 66.97 | 14.01 | 76.11 | 13.57 |
| AD-1479400.1 | 26.46 | 3.84 | 50.16 | 7.83 | 77.00 | 16.24 |
| AD-1479401.1 | 14.67 | 3.25 | 36.91 | 7.56 | 60.75 | 9.50 |
| AD-1479402.1 | 18.55 | 2.16 | 40.23 | 6.63 | 65.32 | 9.53 |
| AD-1479403.1 | 18.00 | 1.15 | 38.70 | 3.77 | 58.14 | 12.26 |
| AD-1479404.1 | 21.38 | 2.80 | 29.69 | 4.16 | 56.93 | 14.45 |
| AD-1479405.1 | 15.85 | 4.03 | 28.15 | 5.44 | 44.64 | 8.56 |
| AD-1479406.1 | 16.92 | 0.29 | 36.24 | 5.32 | 53.50 | 2.57 |
| AD-1479407.1 | 23.54 | 1.76 | 21.01 | 4.97 | 56.23 | 8.47 |
| AD-1479408.1 | 21.03 | 1.82 | 30.88 | 6.36 | 56.85 | 6.10 |
| AD-1479409.1 | 22.92 | 3.73 | 44.89 | 5.55 | 68.09 | 6.93 |
| AD-1479410.1 | 18.25 | 4.82 | 39.37 | 4.09 | 61.13 | 10.17 |
| AD-1479411.1 | 14.08 | 2.22 | 42.44 | 1.98 | 47.58 | 10.60 |
| AD-1479412.1 | 36.87 | 5.55 | 42.48 | 3.19 | 81.01 | 5.10 |
| AD-1479413.1 | 36.52 | 7.54 | 37.35 | 7.69 | 64.91 | 4.50 |
| AD-1479414.1 | 23.48 | 2.64 | 45.97 | 10.29 | 60.47 | 1.44 |
| AD-1479415.1 | 25.78 | 3.27 | 42.28 | 8.67 | 67.23 | 8.22 |
| AD-1479416.1 | 32.26 | 0.81 | 52.88 | 3.11 | 85.61 | 9.71 |
| AD-1479417.1 | 25.89 | 4.12 | 57.24 | 10.15 | 73.76 | 12.58 |
| AD-1479418.1 | 50.84 | 5.51 | 84.77 | 11.67 | 86.23 | 9.86 |
| AD-1479419.1 | 81.24 | 13.71 | 86.77 | 18.63 | 109.03 | 3.82 |
| AD-1479420.1 | 33.82 | 4.30 | 48.85 | 7.44 | 55.89 | 4.72 |
| AD-1479421.1 | 27.81 | 2.72 | 55.22 | 13.15 | 71.11 | 7.85 |
| AD-1479422.1 | 24.35 | 3.45 | 46.73 | 12.34 | 72.10 | 8.19 |
| AD-1479423.1 | 38.85 | 8.70 | 69.75 | 11.36 | 94.64 | 10.27 |
| AD-1479424.1 | 60.95 | 9.16 | 84.22 | 24.95 | 100.52 | 8.74 |
| AD-1479425.1 | 49.93 | 5.03 | 81.50 | 3.59 | 106.39 | 17.05 |
| AD-1479426.1 | 64.96 | 3.02 | 107.97 | 24.24 | 111.97 | 10.08 |
| AD-1479427.1 | 53.66 | 9.36 | 49.75 | 1.44 | 83.24 | 4.12 |
| AD-1479428.1 | 54.54 | 13.38 | 61.03 | 10.13 | 95.32 | 5.55 |
| AD-1479429.1 | 28.06 | 0.11 | 34.65 | 13.04 | 68.26 | 6.60 |
| AD-1479430.1 | 41.79 | 7.33 | 34.04 | 2.47 | 85.11 | 12.69 |

TABLE 9-continued

ANGPTL3 Dose Screen in Primary Cynomolgus Hepatocytes (PCH)

| | 10 nM | | 1 nM | | 0.1 nM | |
|---|---|---|---|---|---|---|
| Duplex | % Avg Message Remaining | STDEV | % Avg Message Remaining | STDEV | % Avg Message Remaining | STDEV |
| AD-1479431.1 | 41.03 | 5.73 | 40.66 | 14.93 | 79.67 | 8.18 |
| AD-1479432.1 | 24.77 | 2.72 | 39.12 | 12.26 | 62.46 | 10.43 |
| AD-1479433.1 | 22.76 | 4.25 | 39.21 | 7.40 | 55.17 | 1.73 |
| AD-1479434.1 | 22.41 | 3.01 | 30.94 | 4.88 | 67.71 | 2.90 |
| AD-1479435.1 | 46.22 | 2.94 | 37.66 | 6.83 | 70.31 | 12.03 |
| AD-1479436.1 | 53.57 | 9.68 | 66.50 | 11.98 | 93.07 | 6.61 |
| AD-1479437.1 | 30.05 | 2.19 | 31.48 | 7.94 | 81.65 | 10.22 |
| AD-1479438.1 | 32.45 | 5.46 | 31.69 | 8.74 | 80.44 | 7.35 |
| AD-1479439.1 | 31.32 | 4.75 | 42.83 | 8.67 | 75.05 | 12.99 |
| AD-1479440.1 | 24.78 | 3.63 | 34.04 | 6.04 | 59.37 | 4.97 |
| AD-1479441.1 | 19.12 | 1.68 | 24.28 | 6.41 | 56.31 | 11.28 |
| AD-1479442.1 | 32.17 | 3.43 | 38.40 | 4.55 | 64.80 | 4.34 |
| AD-1479443.1 | 30.40 | 1.97 | 41.56 | 10.74 | 78.97 | 13.24 |
| AD-1479444.1 | 53.81 | 9.16 | 69.98 | 18.91 | 99.85 | 14.28 |
| AD-1479445.1 | 35.46 | 6.89 | 45.54 | 8.33 | 71.44 | 7.16 |
| AD-1479446.1 | 31.98 | 4.88 | 22.01 | 3.01 | 61.20 | 13.17 |
| AD-1479447.1 | 24.59 | 1.80 | 21.52 | 2.02 | 59.10 | 3.71 |
| AD-1479448.1 | 20.40 | 1.50 | 32.92 | 4.93 | 60.39 | 9.30 |
| AD-1479449.1 | 38.49 | 4.54 | 34.93 | 4.00 | 73.51 | 6.96 |
| AD-1479450.1 | 30.67 | 5.77 | 28.39 | 3.06 | 65.84 | 4.88 |
| AD-1479451.1 | 32.03 | 1.24 | 54.77 | 8.19 | 66.14 | 6.03 |
| AD-1479452.1 | 47.19 | 8.86 | 70.69 | 2.08 | 86.72 | 21.00 |
| AD-1479453.1 | 62.14 | 2.67 | 67.53 | 3.34 | 113.26 | 3.76 |
| AD-1479454.1 | 109.81 | 13.06 | 93.99 | 2.92 | 58.69 | 2.73 |
| AD-1479455.1 | 32.58 | 10.08 | 39.20 | 10.59 | 42.16 | 4.54 |
| AD-1479456.1 | 34.33 | 2.41 | 38.06 | 8.00 | 45.02 | 8.84 |
| AD-1479457.1 | 26.03 | 8.91 | 33.26 | 9.15 | 51.76 | 4.91 |
| AD-1479458.1 | 38.72 | 5.70 | 61.21 | 7.99 | 72.12 | 10.10 |
| AD-1479459.1 | 31.06 | 2.30 | 46.84 | 10.36 | 64.49 | 8.60 |
| AD-1479460.1 | 36.10 | 0.53 | 38.93 | 11.60 | 46.56 | 9.61 |
| AD-1479461.1 | 49.69 | 14.23 | 64.11 | 10.16 | 64.82 | 10.62 |
| AD-1479462.1 | 38.10 | 4.32 | 53.00 | 5.77 | 51.24 | 8.83 |
| AD-1479463.1 | 29.29 | 3.76 | 41.94 | 8.30 | 61.26 | 10.42 |
| AD-1479464.1 | 48.97 | 4.76 | 66.96 | 17.46 | 109.86 | 17.74 |
| AD-1479465.1 | 98.84 | 16.78 | 105.30 | 11.34 | 113.42 | 18.73 |
| AD-1479466.1 | 39.24 | 7.52 | 67.82 | 6.21 | 106.86 | 10.90 |
| AD-1479467.1 | 65.56 | 13.36 | 89.24 | 24.01 | 128.50 | 14.14 |
| AD-1479468.1 | 36.93 | 5.50 | 52.94 | 18.31 | 69.18 | 9.94 |
| AD-1479469.1 | 57.21 | 6.51 | 86.69 | 11.17 | 69.71 | 10.74 |
| AD-1479470.1 | 86.09 | 12.11 | 88.91 | 15.03 | 96.18 | 15.66 |
| AD-1479471.1 | 64.25 | 8.99 | 70.62 | 9.85 | 119.81 | 12.25 |
| AD-1479472.1 | 42.02 | 5.71 | 69.00 | 7.98 | 102.53 | 23.14 |
| AD-1479473.1 | 24.01 | 6.34 | 60.89 | 3.70 | 79.05 | 6.27 |
| AD-1479474.1 | 13.49 | 2.03 | 28.93 | 9.44 | 35.40 | 5.48 |
| AD-1479475.1 | 20.47 | 1.73 | 42.26 | 8.24 | 30.02 | 8.45 |
| AD-1479476.1 | 18.07 | 6.80 | 37.75 | 14.77 | 42.84 | 8.79 |
| AD-1479477.1 | 27.36 | 6.67 | 54.67 | 11.39 | 79.19 | 18.42 |
| AD-1479478.1 | 28.06 | 7.96 | 32.84 | 6.87 | 83.29 | 17.40 |
| AD-1479479.1 | 26.54 | 6.18 | 48.54 | 10.73 | 83.40 | 6.36 |
| AD-1479480.1 | 23.79 | 4.31 | 40.17 | 13.79 | 79.79 | 14.19 |
| AD-1479481.1 | 19.44 | 4.33 | 34.39 | 10.89 | 39.32 | 7.47 |
| AD-1479482.1 | 20.96 | 1.55 | 41.32 | 11.54 | 29.05 | 1.65 |
| AD-1479483.1 | 21.13 | 3.90 | 38.58 | 7.09 | 48.12 | 8.51 |
| AD-1479484.1 | 26.29 | 5.13 | 46.10 | 12.66 | 55.17 | 8.09 |
| AD-1479485.1 | 36.56 | 8.06 | 47.42 | 4.42 | 68.70 | 5.47 |
| AD-1479486.1 | 26.10 | 8.69 | 47.98 | 4.74 | 91.73 | 17.12 |
| AD-1479487.1 | 27.49 | 7.14 | 57.39 | 4.76 | 83.07 | 12.31 |
| AD-1479488.1 | 12.46 | 3.09 | 22.12 | 2.70 | 65.46 | 13.64 |
| AD-1479489.1 | 23.50 | 4.20 | 43.78 | 3.19 | 26.93 | 2.48 |
| AD-1479490.1 | 24.91 | 4.58 | 36.16 | 2.50 | 38.67 | 8.14 |
| AD-1479491.1 | 17.96 | 0.44 | 37.69 | 7.51 | 52.46 | 14.94 |
| AD-1479492.1 | 17.16 | 5.40 | 23.26 | 3.68 | 53.32 | 11.48 |
| AD-1479493.1 | 39.85 | 5.04 | 43.16 | 14.17 | 103.09 | 8.75 |
| AD-1479494.1 | 24.55 | 10.40 | 44.63 | 6.21 | 64.10 | 7.84 |
| AD-1479495.1 | 26.79 | 9.37 | 45.44 | 7.49 | 68.61 | 12.47 |
| AD-1479496.1 | 37.70 | 5.80 | 79.45 | 5.42 | 52.05 | 2.04 |
| AD-1479497.1 | 19.94 | 2.51 | 55.28 | 9.15 | 67.55 | 13.60 |
| AD-1479498.1 | 23.47 | 7.35 | 38.30 | 6.65 | 75.40 | 9.32 |
| AD-1479499.1 | 22.56 | 4.30 | 50.37 | 6.18 | 103.58 | 26.12 |
| AD-1479500.1 | 36.43 | 8.14 | 42.46 | 19.64 | 112.00 | 12.08 |
| AD-1479501.1 | 19.57 | 5.58 | 39.48 | 13.76 | 65.35 | 5.54 |
| AD-1479502.1 | 21.52 | 7.06 | 40.25 | 10.08 | 82.14 | 3.92 |

TABLE 9-continued

ANGPTL3 Dose Screen in Primary Cynomolgus Hepatocytes (PCH)

| Duplex | 10 nM | | 1 nM | | 0.1 nM | |
|---|---|---|---|---|---|---|
| | % Avg Message Remaining | STDEV | % Avg Message Remaining | STDEV | % Avg Message Remaining | STDEV |
| AD-1479503.1 | 25.61 | 4.21 | 35.97 | 9.20 | 42.53 | 6.68 |
| AD-1479504.1 | 44.17 | 3.59 | 85.62 | 11.11 | 74.61 | 20.24 |
| AD-1479505.1 | 35.41 | 6.70 | 67.31 | 11.33 | 90.56 | 25.07 |
| AD-1479506.1 | 40.57 | 4.91 | 75.46 | 3.63 | 77.84 | 13.98 |
| AD-1479507.1 | 36.24 | 1.16 | 57.87 | 11.93 | 90.58 | 15.11 |
| AD-1479508.1 | 26.26 | 1.96 | 41.71 | 3.04 | 87.84 | 20.80 |
| AD-1479509.1 | 36.83 | 3.05 | 61.90 | 4.66 | 98.42 | 19.40 |
| AD-1479510.1 | 34.79 | 2.17 | 45.38 | 10.17 | 82.24 | 10.05 |
| AD-1479511.1 | 35.10 | 6.24 | 49.37 | 11.18 | 37.46 | 9.73 |
| AD-1479512.1 | 25.99 | 5.51 | 54.32 | 6.33 | 53.60 | 13.57 |
| AD-1479513.1 | 21.56 | 6.48 | 25.88 | 15.98 | 73.48 | 16.15 |
| AD-1479514.1 | 19.43 | 6.82 | 44.34 | 10.63 | 64.34 | 8.45 |
| AD-1479515.1 | 25.18 | 8.67 | 39.57 | 16.86 | 85.87 | 8.35 |
| AD-1479516.1 | 38.16 | 5.84 | 53.95 | 7.12 | 96.45 | 9.65 |
| AD-1479517.1 | 39.56 | 10.21 | 51.49 | 8.41 | 59.11 | 9.25 |
| AD-1479518.1 | 33.94 | 7.42 | 53.59 | 12.98 | 31.54 | 2.94 |
| AD-1479519.1 | 43.12 | 8.26 | 63.00 | 10.67 | 64.42 | 9.27 |
| AD-1479520.1 | 22.82 | 6.08 | 41.72 | 16.75 | 80.11 | 19.91 |
| AD-1479521.1 | 26.02 | 2.29 | 48.99 | 9.22 | 91.48 | 14.66 |
| AD-1479522.1 | 43.26 | 6.15 | 61.44 | 16.38 | 79.92 | 15.83 |
| AD-1479523.1 | 44.07 | 3.24 | 66.18 | 5.97 | 103.15 | 9.97 |
| AD-1479524.1 | 63.42 | 9.40 | 76.50 | 13.58 | 93.92 | 20.94 |
| AD-1479525.1 | 61.13 | 7.14 | 74.69 | 10.00 | 55.51 | 5.76 |
| AD-1479526.1 | 45.18 | 6.46 | 66.41 | 9.41 | 56.67 | 4.28 |
| AD-1479527.1 | 39.53 | 5.39 | 55.03 | 9.70 | 55.04 | 2.46 |
| AD-1479528.1 | 42.61 | 14.62 | 63.30 | 6.12 | 89.09 | 17.17 |
| AD-1479529.1 | 40.15 | 6.52 | 55.13 | 6.97 | 91.58 | 18.95 |
| AD-1479530.1 | 43.63 | 1.77 | 55.22 | 5.79 | 91.83 | 11.83 |
| AD-1479531.1 | 35.71 | 4.54 | 43.24 | 7.42 | 64.00 | 12.70 |
| AD-1479532.1 | 37.43 | 7.12 | 44.99 | 3.16 | 51.75 | 4.05 |
| AD-1479533.1 | 31.71 | 5.48 | 49.18 | 5.98 | 54.17 | 7.90 |
| AD-1479534.1 | 75.18 | 5.91 | 80.12 | 9.23 | 69.93 | 6.07 |
| AD-1479535.1 | 43.87 | 2.79 | 53.58 | 7.92 | 44.33 | 9.04 |
| AD-1479536.1 | 56.99 | 11.10 | 67.52 | 13.00 | 76.03 | 17.66 |
| AD-1479537.1 | 43.81 | 2.50 | 57.35 | 9.20 | 71.02 | 15.35 |
| AD-1479538.1 | 35.44 | 1.57 | 51.51 | 6.24 | 72.09 | 11.75 |

TABLE 10

| ANGPTL3 Dose Screen in Hep3B Cells Duplex | 10 nM | | 1 nM | | 0.1 nM | |
|---|---|---|---|---|---|---|
| | % Avg Message Remaining | STDEV | % Avg Message Remaining | STDEV | % Avg Message Remaining | STDEV |
| AD-1331203.3 | 2.56 | 1.05 | 5.78 | 1.82 | 10.71 | 1.51 |
| AD-1331206.3 | 1.59 | 0.49 | 3.68 | 1.19 | 19.15 | 7.31 |
| AD-1331209.3 | 1.89 | 1.43 | 2.94 | 0.99 | 10.29 | 3.96 |
| AD-1331212.3 | 0.82 | 0.21 | 2.92 | 1.20 | 12.51 | 3.50 |
| AD-1331213.3 | 0.97 | 0.25 | 3.01 | 1.07 | 4.87 | 1.01 |
| AD-1331240.3 | 2.30 | 0.82 | 2.72 | 1.01 | 9.26 | 2.42 |
| AD-1331262.3 | 1.68 | 0.65 | 2.74 | 1.49 | 6.89 | 2.53 |
| AD-1331264.3 | 1.26 | 0.68 | 2.09 | 0.53 | 4.45 | 0.98 |
| AD-1331265.3 | 1.22 | 0.69 | 1.39 | 0.24 | 4.62 | 0.78 |
| AD-1331266.3 | 1.45 | 0.45 | 2.81 | 1.69 | 8.40 | 3.51 |
| AD-1331329.3 | 1.87 | 0.47 | 3.71 | 0.62 | 9.98 | 3.76 |
| AD-1479370.1 | 0.70 | 0.26 | 1.70 | 0.37 | 6.01 | 2.25 |
| AD-1479371.1 | 1.24 | 0.34 | 3.32 | 0.89 | 8.65 | 2.31 |
| AD-1479372.1 | 0.74 | 0.32 | 2.21 | 0.66 | 7.22 | 1.47 |
| AD-1479373.1 | 1.62 | 0.72 | 3.18 | 1.07 | 8.00 | 3.21 |
| AD-1479374.1 | 0.82 | 0.55 | 1.90 | 0.84 | 3.94 | 1.09 |
| AD-1479375.1 | 1.23 | 0.43 | 2.97 | 0.94 | 6.46 | 2.32 |
| AD-1479376.1 | 0.71 | 0.47 | 0.98 | 0.40 | 1.63 | 0.98 |
| AD-1479377.1 | 1.27 | 0.28 | 3.78 | 0.97 | 13.89 | 3.72 |
| AD-1479378.1 | 1.27 | 0.25 | 3.99 | 1.54 | 5.86 | 0.67 |
| AD-1479379.1 | 2.66 | 0.73 | 9.10 | 4.04 | 20.53 | 3.84 |
| AD-1479380.1 | 1.87 | 0.74 | 7.68 | 4.32 | 20.84 | 7.70 |
| AD-1479381.1 | 4.42 | 0.26 | 16.16 | 3.26 | 36.78 | 6.88 |
| AD-1479382.1 | 4.57 | 0.62 | 13.52 | 5.37 | 32.46 | 5.88 |

TABLE 10-continued

| ANGPTL3 Dose | 10 nM | | 1 nM | | 0.1 nM | |
|---|---|---|---|---|---|---|
| Screen in Hep3B Cells Duplex | % Avg Message Remaining | STDEV | % Avg Message Remaining | STDEV | % Avg Message Remaining | STDEV |
| AD-1479383.1 | 0.84 | 0.31 | 2.35 | 0.81 | 1.67 | 1.12 |
| AD-1479384.1 | 1.93 | 0.64 | 5.83 | 2.83 | 14.73 | 4.19 |
| AD-1479385.1 | 1.08 | 0.37 | 4.13 | 1.65 | 6.43 | 2.09 |
| AD-1479386.1 | 2.83 | 0.83 | 8.74 | 4.58 | 19.64 | 9.39 |
| AD-1479387.1 | 1.10 | 0.14 | 4.44 | 1.43 | 6.84 | 4.38 |
| AD-1479388.1 | 2.99 | 0.86 | 10.08 | 3.07 | 29.02 | 7.17 |
| AD-1479389.1 | 1.54 | 0.11 | 4.33 | 1.51 | 8.33 | 5.53 |
| AD-1479390.1 | 10.13 | 3.41 | 16.53 | 6.45 | 23.79 | 9.14 |
| AD-1479391.1 | 1.17 | 0.38 | 3.09 | 1.06 | 10.15 | 3.02 |
| AD-1479392.1 | 7.63 | 1.83 | 31.21 | 15.94 | 57.54 | 10.66 |
| AD-1479393.1 | 52.13 | 15.03 | 69.88 | 13.74 | 91.32 | 19.61 |
| AD-1479394.1 | 9.00 | 2.71 | 22.63 | 2.67 | 51.95 | 6.90 |
| AD-1479395.1 | 40.22 | 7.66 | 52.41 | 18.64 | 96.34 | 3.49 |
| AD-1479396.1 | 1.07 | 0.46 | 1.70 | 1.35 | 6.63 | 6.58 |
| AD-1479397.1 | 0.86 | 0.36 | 3.53 | 1.18 | 5.91 | 1.45 |
| AD-1479398.1 | 1.50 | 0.90 | 6.42 | 3.46 | 10.99 | 3.66 |
| AD-1479399.1 | 3.54 | 0.92 | 8.49 | 2.78 | 27.55 | 7.38 |
| AD-1479400.1 | 1.11 | 0.24 | 3.20 | 0.78 | 12.77 | 7.00 |
| AD-1479401.1 | 1.95 | 0.33 | 4.82 | 1.58 | 13.65 | 4.06 |
| AD-1479402.1 | 1.34 | 0.38 | 3.79 | 0.76 | 5.90 | 2.65 |
| AD-1479403.1 | 1.52 | 0.34 | 3.81 | 2.15 | 8.67 | 3.83 |
| AD-1479404.1 | 1.39 | 0.75 | 2.32 | 1.87 | 5.86 | 2.43 |
| AD-1479405.1 | 1.34 | 0.06 | 4.79 | 1.59 | 10.28 | 2.81 |
| AD-1479406.1 | 1.23 | 0.43 | 7.02 | 3.49 | 14.07 | 1.53 |
| AD-1479407.1 | 1.16 | 0.10 | 3.91 | 1.77 | 10.39 | 3.52 |
| AD-1479408.1 | 1.49 | 0.35 | 4.94 | 0.91 | 11.23 | 2.72 |
| AD-1479409.1 | 1.99 | 0.80 | 4.21 | 0.91 | 9.22 | 3.17 |
| AD-1479410.1 | 1.42 | 0.58 | 3.36 | 1.67 | 9.71 | 0.44 |
| AD-1479411.1 | 1.35 | 0.56 | 2.50 | 0.93 | 7.70 | 3.21 |
| AD-1479412.1 | 3.89 | 2.46 | 13.62 | 4.70 | 28.28 | 8.42 |
| AD-1479413.1 | 1.62 | 0.66 | 7.37 | 3.37 | 19.00 | 8.01 |
| AD-1479414.1 | 1.40 | 0.28 | 4.70 | 2.02 | 9.41 | 5.26 |
| AD-1479415.1 | 2.41 | 1.04 | 4.57 | 2.30 | 13.68 | 5.43 |
| AD-1479416.1 | 2.20 | 0.48 | 4.53 | 2.94 | 24.63 | 9.63 |
| AD-1479417.1 | 2.25 | 1.02 | 3.34 | 0.57 | 7.95 | 3.77 |
| AD-1479418.1 | 39.69 | 14.09 | 45.94 | 2.87 | 48.92 | 7.24 |
| AD-1479419.1 | 75.56 | 19.77 | 79.76 | 10.85 | 110.17 | 27.25 |
| AD-1479420.1 | 2.52 | 1.06 | 8.41 | 3.93 | 18.16 | 10.80 |
| AD-1479421.1 | 2.74 | 0.57 | 5.73 | 2.36 | 15.54 | 5.49 |
| AD-1479422.1 | 2.10 | 0.48 | 5.58 | 2.03 | 18.31 | 3.85 |
| AD-1479423.1 | 3.82 | 2.55 | 7.74 | 3.06 | 25.71 | 11.02 |
| AD-1479424.1 | 4.02 | 1.23 | 9.16 | 2.94 | 37.90 | 13.00 |
| AD-1479425.1 | 2.85 | 0.89 | 7.17 | 3.66 | 25.10 | 6.27 |
| AD-1479426.1 | 55.96 | 15.59 | 61.93 | 8.78 | 49.65 | 5.04 |
| AD-1479427.1 | 10.33 | 3.51 | 22.90 | 9.60 | 49.16 | 20.17 |
| AD-1479428.1 | 9.77 | 2.51 | 25.64 | 11.07 | 56.36 | 12.52 |
| AD-1479429.1 | 1.49 | 0.59 | 3.54 | 1.79 | 12.59 | 5.62 |
| AD-1479430.1 | 1.62 | 0.43 | 4.61 | 1.88 | 9.64 | 4.08 |
| AD-1479431.1 | 1.35 | 0.44 | 2.44 | 0.54 | 8.11 | 2.77 |
| AD-1479432.1 | 1.62 | 0.72 | 2.38 | 1.34 | 6.91 | 2.49 |
| AD-1479433.1 | 0.99 | 0.21 | 1.94 | 0.86 | 7.22 | 1.09 |
| AD-1479434.1 | 0.90 | 0.25 | 5.97 | 2.64 | 12.11 | 5.31 |
| AD-1479435.1 | 1.73 | 0.73 | 6.13 | 3.34 | 14.69 | 4.81 |
| AD-1479436.1 | 1.05 | 0.20 | 3.67 | 0.65 | 11.24 | 2.31 |
| AD-1479437.1 | 0.95 | 0.27 | 2.17 | 0.44 | 4.90 | 1.31 |
| AD-1479438.1 | 1.42 | 0.49 | 1.92 | 0.28 | 6.34 | 1.69 |
| AD-1479439.1 | 2.21 | 1.72 | 2.95 | 1.13 | 10.06 | 5.02 |
| AD-1479440.1 | 0.97 | 0.44 | 4.16 | 2.40 | 5.58 | 2.58 |
| AD-1479441.1 | 1.43 | 0.24 | 5.17 | 2.44 | 10.85 | 5.96 |
| AD-1479442.1 | 1.71 | 0.82 | 7.03 | 2.96 | 15.78 | 1.59 |
| AD-1479443.1 | 1.99 | 0.15 | 4.20 | 1.76 | 15.11 | 6.13 |
| AD-1479444.1 | 3.76 | 2.20 | 9.85 | 1.92 | 33.56 | 2.89 |
| AD-1479445.1 | 1.33 | 0.41 | 3.61 | 0.56 | 9.38 | 3.59 |
| AD-1479446.1 | 0.83 | 0.13 | 2.52 | 0.88 | 5.05 | 3.97 |
| AD-1479447.1 | 0.65 | 0.24 | 2.33 | 1.08 | 6.13 | 3.55 |
| AD-1479448.1 | 1.00 | 0.37 | 2.35 | 0.92 | 3.72 | 2.25 |
| AD-1479449.1 | 1.50 | 0.31 | 10.17 | 1.89 | 18.74 | 1.57 |
| AD-1479450.1 | 1.21 | 0.36 | 5.21 | 2.18 | 10.41 | 5.80 |
| AD-1479451.1 | 0.66 | 0.12 | 3.73 | 1.58 | 13.22 | 3.90 |
| AD-1479452.1 | 2.08 | 0.55 | 9.13 | 2.38 | 22.72 | 0.97 |
| AD-1479453.1 | 15.54 | 5.16 | 32.78 | 10.94 | 71.93 | 22.57 |
| AD-1479454.1 | 65.02 | 10.00 | 91.33 | 19.38 | 90.24 | 26.68 |
| AD-1479455.1 | 1.57 | 0.66 | 2.83 | 0.87 | 7.39 | 1.03 |
| AD-1479456.1 | 2.22 | 0.41 | 2.75 | 0.92 | 6.08 | 2.03 |

TABLE 10-continued

| ANGPTL3 Dose | 10 nM | | 1 nM | | 0.1 nM | |
|---|---|---|---|---|---|---|
| Screen in Hep3B Cells Duplex | % Avg Message Remaining | STDEV | % Avg Message Remaining | STDEV | % Avg Message Remaining | STDEV |
| AD-1479457.1 | 1.72 | 0.69 | 2.71 | 0.39 | 4.41 | 1.23 |
| AD-1479458.1 | 1.95 | 0.95 | 2.25 | 0.58 | 9.40 | 1.30 |
| AD-1479459.1 | 1.44 | 0.47 | 2.75 | 1.38 | 7.52 | 3.58 |
| AD-1479460.1 | 1.25 | 0.79 | 1.62 | 0.62 | 3.19 | 1.13 |
| AD-1479461.1 | 15.71 | 6.42 | 40.90 | 1.81 | 70.79 | 13.15 |
| AD-1479462.1 | 2.69 | 0.63 | 5.07 | 1.15 | 14.25 | 1.23 |
| AD-1479463.1 | 1.93 | 0.40 | 3.44 | 0.69 | 13.10 | 4.65 |
| AD-1479464.1 | 21.21 | 2.94 | 37.83 | 9.54 | 55.70 | 10.96 |
| AD-1479465.1 | 94.02 | 21.46 | 89.76 | 13.33 | 84.42 | 8.02 |
| AD-1479466.1 | 2.97 | 0.43 | 5.33 | 0.78 | 20.98 | 3.01 |
| AD-1479467.1 | 34.59 | 8.40 | 56.36 | 9.71 | 65.42 | 7.49 |
| AD-1479468.1 | 3.55 | 1.69 | 6.16 | 2.61 | 23.62 | 6.69 |
| AD-1479469.1 | 7.19 | 2.25 | 31.75 | 8.89 | 59.45 | 14.83 |
| AD-1479470.1 | 34.57 | 7.26 | 71.66 | 16.04 | 77.20 | 20.04 |
| AD-1479471.1 | 19.71 | 6.12 | 42.15 | 7.03 | 62.85 | 10.38 |
| AD-1479472.1 | 3.25 | 0.90 | 8.58 | 1.59 | 22.27 | 2.50 |
| AD-1479473.1 | 1.94 | 0.35 | 2.95 | 0.97 | 7.67 | 2.15 |
| AD-1479474.1 | 0.72 | 0.16 | 0.91 | 0.41 | 1.81 | 0.86 |
| AD-1479475.1 | 1.03 | 0.29 | 1.51 | 0.75 | 6.54 | 1.76 |
| AD-1479476.1 | 1.69 | 0.23 | 2.37 | 0.53 | 6.27 | 1.89 |
| AD-1479477.1 | 2.10 | 0.47 | 4.60 | 1.46 | 8.94 | 2.45 |
| AD-1479478.1 | 1.41 | 0.53 | 2.68 | 0.61 | 5.84 | 1.48 |
| AD-1479479.1 | 1.23 | 0.26 | 1.92 | 1.14 | 4.62 | 0.98 |
| AD-1479480.1 | 1.13 | 0.18 | 1.77 | 0.21 | 5.83 | 0.97 |
| AD-1479481.1 | 0.71 | 0.20 | 1.14 | 0.53 | 2.83 | 0.33 |
| AD-1479482.1 | 1.17 | 0.57 | 1.42 | 0.61 | 4.95 | 3.07 |
| AD-1479483.1 | 1.59 | 0.19 | 2.93 | 0.55 | 6.52 | 2.36 |
| AD-1479484.1 | 1.95 | 0.62 | 5.28 | 0.79 | 16.09 | 4.36 |
| AD-1479485.1 | 10.21 | 3.88 | 24.41 | 3.03 | 46.43 | 8.45 |
| AD-1479486.1 | 1.26 | 0.18 | 3.37 | 1.25 | 9.94 | 2.95 |
| AD-1479487.1 | 1.24 | 0.41 | 2.37 | 0.59 | 6.36 | 0.97 |
| AD-1479488.1 | 0.94 | 0.36 | 1.17 | 0.17 | 2.68 | 0.88 |
| AD-1479489.1 | 1.24 | 0.48 | 4.32 | 2.08 | 8.54 | 1.70 |
| AD-1479490.1 | 1.48 | 0.43 | 3.10 | 1.01 | 12.12 | 3.82 |
| AD-1479491.1 | 2.94 | 0.42 | 8.38 | 1.49 | 16.68 | 0.57 |
| AD-1479492.1 | 2.73 | 0.80 | 5.36 | 2.91 | 16.03 | 2.29 |
| AD-1479493.1 | 2.21 | 0.39 | 7.03 | 1.87 | 21.40 | 3.70 |
| AD-1479494.1 | 2.24 | 0.67 | 5.00 | 1.88 | 17.67 | 5.78 |
| AD-1479495.1 | 1.15 | 0.26 | 2.50 | 1.01 | 11.45 | 2.94 |
| AD-1479496.1 | 3.36 | 1.10 | 9.57 | 2.48 | 21.08 | 7.08 |
| AD-1479497.1 | 1.81 | 0.10 | 4.07 | 2.09 | 14.57 | 6.34 |
| AD-1479498.1 | 2.36 | 0.60 | 3.43 | 1.71 | 12.93 | 4.00 |
| AD-1479499.1 | 1.44 | 0.31 | 3.14 | 1.38 | 8.29 | 1.30 |
| AD-1479500.1 | 2.29 | 0.42 | 5.32 | 2.50 | 17.09 | 5.09 |
| AD-1479501.1 | 1.53 | 0.34 | 2.65 | 0.72 | 10.66 | 2.02 |
| AD-1479502.1 | 1.11 | 0.23 | 3.36 | 1.32 | 10.09 | 3.35 |
| AD-1479503.1 | 1.14 | 0.79 | 1.38 | 0.84 | 3.36 | 2.03 |
| AD-1479504.1 | 2.25 | 0.35 | 8.68 | 2.33 | 21.53 | 8.29 |
| AD-1479505.1 | 1.71 | 0.54 | 4.90 | 2.53 | 10.14 | 3.64 |
| AD-1479506.1 | 2.09 | 0.75 | 4.57 | 1.13 | 12.90 | 1.93 |
| AD-1479507.1 | 4.54 | 0.69 | 13.63 | 2.25 | 33.97 | 4.86 |
| AD-1479508.1 | 1.82 | 0.53 | 6.13 | 0.67 | 23.73 | 4.03 |
| AD-1479509.1 | 4.80 | 1.98 | 8.33 | 0.80 | 29.49 | 14.92 |
| AD-1479510.1 | 0.58 | 0.21 | 1.25 | 0.52 | 3.52 | 0.80 |
| AD-1479511.1 | 1.36 | 0.36 | 3.50 | 2.20 | 9.28 | 2.77 |
| AD-1479512.1 | 1.11 | 0.44 | 2.19 | 0.76 | 6.64 | 2.72 |
| AD-1479513.1 | 3.46 | 0.90 | 7.66 | 2.66 | 20.30 | 8.67 |
| AD-1479514.1 | 1.35 | 0.42 | 2.47 | 1.68 | 5.16 | 2.20 |
| AD-1479515.1 | 11.22 | 1.44 | 36.27 | 10.10 | 57.69 | 8.34 |
| AD-1479516.1 | 2.03 | 0.53 | 4.16 | 0.78 | 17.23 | 8.59 |
| AD-1479517.1 | 1.80 | 0.62 | 3.09 | 1.42 | 11.87 | 2.55 |
| AD-1479518.1 | 0.76 | 0.24 | 2.07 | 0.76 | 4.62 | 1.33 |
| AD-1479519.1 | 8.53 | 1.62 | 17.79 | 1.36 | 56.60 | 18.23 |
| AD-1479520.1 | 2.94 | 0.56 | 4.64 | 2.17 | 15.83 | 5.06 |
| AD-1479521.1 | 1.67 | 0.50 | 4.71 | 1.84 | 12.38 | 5.24 |
| AD-1479522.1 | 6.66 | 2.45 | 19.95 | 1.02 | 42.74 | 9.16 |
| AD-1479523.1 | 1.45 | 0.27 | 2.25 | 0.82 | 5.24 | 1.59 |
| AD-1479524.1 | 3.72 | 1.08 | 5.93 | 2.08 | 24.05 | 11.86 |
| AD-1479525.1 | 1.49 | 0.65 | 7.18 | 2.11 | 18.32 | 7.26 |
| AD-1479526.1 | 2.83 | 0.37 | 6.65 | 1.60 | 21.57 | 10.68 |
| AD-1479527.1 | 2.15 | 0.29 | 5.42 | 0.58 | 13.22 | 3.12 |
| AD-1479528.1 | 1.50 | 0.31 | 4.55 | 0.92 | 11.97 | 0.58 |
| AD-1479529.1 | 4.69 | 5.91 | 3.30 | 1.22 | 6.02 | 1.83 |
| AD-1479530.1 | 1.82 | 0.62 | 3.38 | 1.07 | 9.22 | 1.73 |

TABLE 10-continued

| Screen in Hep3B Cells Duplex | 10 nM % Avg Message Remaining | STDEV | 1 nM % Avg Message Remaining | STDEV | 0.1 nM % Avg Message Remaining | STDEV |
|---|---|---|---|---|---|---|
| ANGPTL3 Dose | | | | | | |
| AD-1479531.1 | 1.07 | 0.33 | 1.21 | 0.88 | 3.29 | 1.85 |
| AD-1479532.1 | 1.03 | 0.14 | 2.26 | 1.22 | 8.37 | 2.27 |
| AD-1479533.1 | 0.78 | 0.11 | 1.87 | 0.38 | 3.90 | 1.94 |
| AD-1479534.1 | 3.57 | 1.37 | 5.74 | 1.72 | 19.59 | 8.15 |
| AD-1479535.1 | 1.43 | 0.36 | 2.32 | 0.56 | 5.13 | 1.48 |
| AD-1479536.1 | 1.40 | 0.38 | 4.19 | 0.79 | 11.84 | 0.61 |
| AD-1479537.1 | 1.11 | 0.34 | 2.44 | 0.79 | 6.02 | 1.66 |
| AD-1479538.1 | 0.75 | 0.11 | 1.46 | 0.32 | 4.69 | 1.79 |

Example 5: In Vivo Screening of dsRNA Duplexes in Mice

Duplexes of interest, identified from the above in vitro studies, were evaluated in vivo. In particular, mice were transduced with an AAV containing hANGPTL3 (full length human) at 2e11 viral particles per mouse. Four weeks post-transduction, mice were subcutaneously administered a single 3 mg/kg dose of a duplex of interest. At Days 7 and 14 post-dose, sera was collected and the level of hANGPTL3 protein was determined by ELISA (R&D Systems hANPTL3 ELISA, DANL30) The results of these analyses are provided in Table 11 below. An average of three mice were used per time point, and the percent of hANGPTL3 protein compared to samples from PBS control at Day 7 and Day 14 are represented in the Table 11.

TABLE 11

ANGPTL3 dsRNA screen in vivo

| | Average compared to PBS control Day 7 | Average compared to PBS control Day 14 |
|---|---|---|
| PBS | 100 | 100 |
| Naïve | 99.77 | 69.34 |
| AD-1331203.2 | 44.24 | 33.25 |
| AD-1331206.2 | 15.05 | 7.72 |
| AD-1331209.2 | 19.34 | 17.56 |
| AD-1331212.2 | 11.85 | 17.54 |
| AD-1331213.2 | 14.41 | 18.03 |
| AD-1331329.2 | 29.39 | 30.07 |
| AD-1331237.2 | 30.52 | 46.84 |
| AD-1331238.2 | 31.11 | 66.36 |
| AD-1331240.2 | 17.48 | 36.42 |
| AD-1331244.2 | 22.35 | 75.83 |
| AD-1331256.2 | 43.7 | 33.75 |
| AD-1331262.2 | 30.91 | 47.3 |
| AD-1331264.2 | 18.46 | 36.5 |
| AD-1331265.2 | 15.2 | 48.17 |
| AD-1331266.2 | 24.28 | 33.19 |
| AD-1331316.2 | 56.1 | 58.06 |
| AD-1331338.2 | 36.89 | 57.43 |
| AD-74757.13 | 14.5 | 18.42 |

Example 6: SAR Analysis of Selected dsRNA Duplexes In Vivo

Structure-activity-relationship (SAR) analyses were also evaluated in vivo similarly as described above. Briefly, mice were transduced with an AAV containing hANGPTL3 at 2e11 viral particles per mouse. Two weeks post-transduction, mice were subcutaneously administered duplexes of interest, and sera were collected on Day 0 (day of dosing), Day 7, Day 14 and Day 28. hANGPTL3 protein levels were determined by ELISA, as described above. The results, presented as average percent compared to Day 0, are shown in Table 12 and Table 13.

TABLE 12

Structure-activity-relationship (SAR) of ANGPTL3 dsRNAs in vivo-Day 7 and 14 results

| Treatment | Parent | Avg Percent Change Day 7 | Avg Percent Change Day 14 |
|---|---|---|---|
| PBS | n/a | 152.8 | 151.2 |
| Naïve | n/a | 147.2 | 77.2 |
| AD-1331212.4 | parent | 16.3 | 5.9 |
| AD-1479372.2 | AD-1331212.4 | 18 | 8.3 |
| AD-1479374.2 | AD-1331212.4 | 23.4 | 15.3 |
| AD-1479378.2 | AD-1331212.4 | 31.5 | 36.2 |
| AD-1331213.4 | parent | 22.1 | 16.6 |
| AD-1479385.2 | AD-1331213.4 | 21.7 | 33.3 |
| AD-1479391.2 | AD-1331213.4 | 59.1 | 50 |
| AD-1479397.2 | AD-1331264 | 31.5 | 39.2 |
| AD-1331206.4 | parent | 13.4 | 11.4 |
| AD-1479440.2 | AD-1331206.4 | 30.1 | 50.7 |
| AD-1479460.2 | AD-1331240 | 92.9 | 131.5 |
| AD-1479481.2 | AD-1331265 | 21.2 | 44.1 |
| AD-1479482.2 | AD-1331265 | 63.2 | 58.9 |
| AD-1479489.2 | AD-1331262 | 21.2 | 30.7 |
| AD-1479511.2 | AD-1331266 | 51.5 | 128.6 |
| AD-1479533.2 | AD-1331329 | 22.8 | 24.3 |
| AD-74757.14 | Benchmark | 62.3 | 49.6 |

TABLE 13

Structure-activity-relationship (SAR) of ANGPTL3 siRNAs in vivo-Day 28 results

| Treatment | Parent | Avg Percent Change Day 28 | STDEV Day 28 |
|---|---|---|---|
| PBS | n/a | 58.8 | 4.3 |
| Naive | n/a | 66.7 | |
| AD-1331212.4 | parent | 7.5 | 2.7 |
| AD-1479372.2 | AD-1331212.4 | 22.2 | 2.1 |
| AD-1479374.2 | AD-1331212.4 | 26.2 | 7.3 |
| AD-1479378.2 | AD-1331212.4 | 51.2 | 15.1 |
| AD-1331213.4 | parent | 14 | 2.3 |
| AD-1479385.2 | AD-1331213.4 | 59 | 14 |
| AD-1479391.2 | AD-1331213.4 | 77.3 | |
| AD-1479397.2 | AD-1331264 | 56.2 | 21.3 |
| AD-1331206.4 | parent | 20.2 | 3.2 |
| AD-1479440.2 | AD-1331206.4 | 71.2 | 6.4 |
| AD-1479460.2 | AD-1331240 | 80.1 | 24.7 |
| AD-1479481.2 | AD-1331265 | 44.3 | 11.6 |
| AD-1479482.2 | AD-1331265 | 71.6 | 18.4 |
| AD-1479489.2 | AD-1331262 | 119.6 | |
| AD-1479511.2 | AD-1331266 | 90.5 | 22.1 |
| AD-1479533.2 | AD-1331329 | 24.4 | 8.4 |
| AD-74757.14 | Benchmark | 16.7 | 11.4 |

Example 7: Effects of siRNA-GalNAC Conjugates in Non-Human Primate Studies

Figure 3:
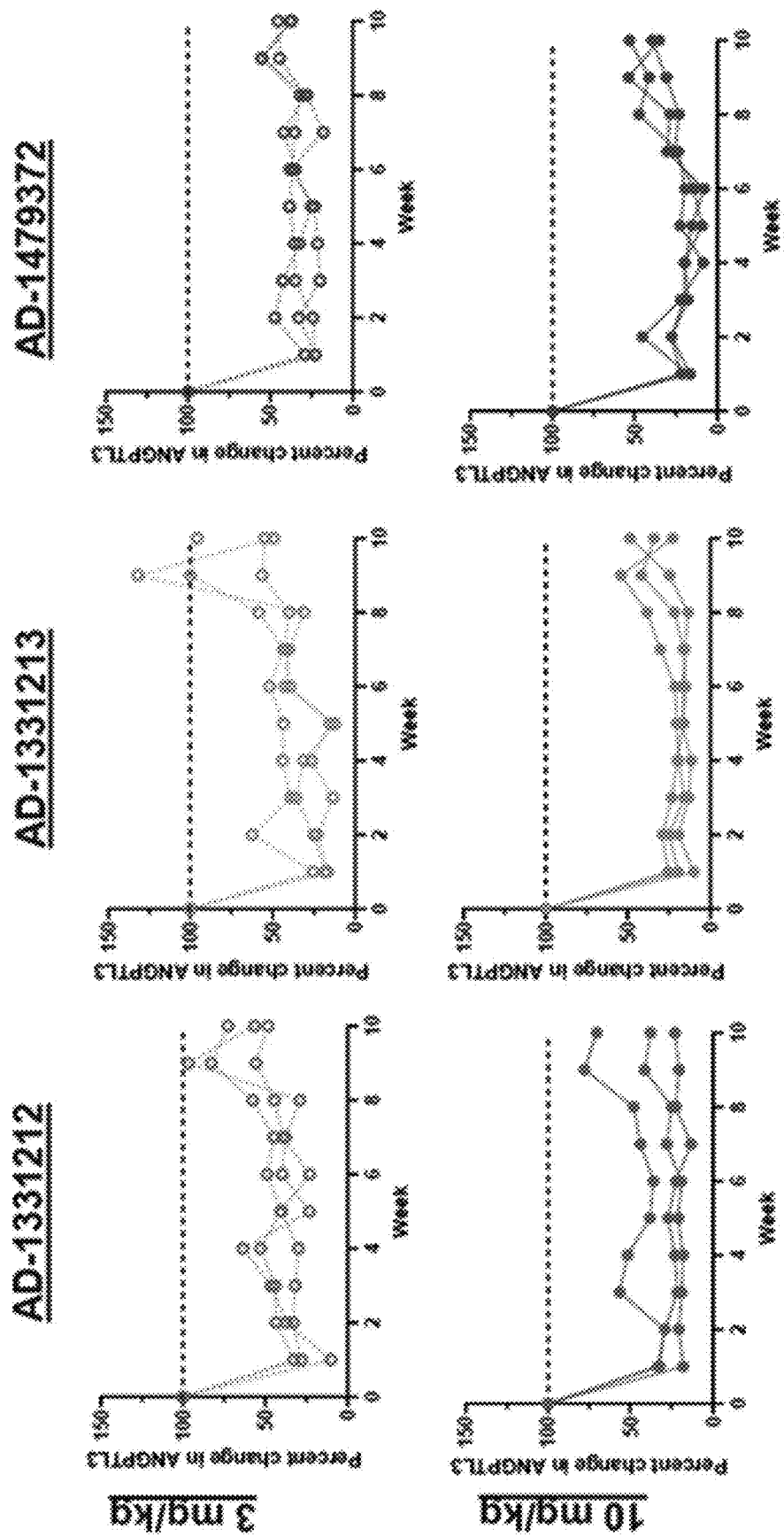
FIG. 3 is a graph showing the level of ANGPTL3 protein in sera of cygnomolgus monkeys (n=3 per group) subcutaneously administered a single dose 3 mg/kg or 10 mg/kg dose of AD-1331212, AD-1331213 or AD-1479372. The levels of ANGPTL3 are shown as percent change compared to Day 0 (dosing day).

Lead candidates from the in vivo studies described above, AD-1331212, AD-1331213 and AD-1479372, were further investigated for their effectiveness in non-human primates. Specifically, a single dose of 3 mg/kg or 10 mg/kg of AD-1331212, AD-1331213 and AD-1479372 were subcutaneously administered to cynomolgous monkeys. Sera were collected from the animals every week, and the serum level of ANGPTL3 protein was determined by ELISA. The results, presented as percent change of ANGPTL3 compared to the level on dosing day (Day 0), are shown in FIG. 3.

EQUIVALENTS

Those skilled in the art will recognize, or be able to ascertain using no more than routine experimentation, many equivalents to the specific embodiments and methods described herein. Such equivalents are intended to be encompassed by the scope of the following claims.

SEQUENCE LISTING (986 sequences)

SEQ ID NO: 1 - DNA, 2951 bp, Homo sapiens
  source 1..2951: mol_type = genomic DNA
atatatagagttaagaagtctaggtctgcttccagaagaaaacagttccacgttgcttgaaattgaaaatcaagataaaaatgttcacaattaagctccttctttttattgttcctctagttatttcctccagaattgatcaagacaattcatcatttgattctctatctccagagccaaaatcaagatttgctatgttagacgatgtaaaaattttagccaatggcctccttcagttgggacatggtcttaaagactttgtccataagacgaagggccaaattaatgacatatttcaaaaactcaacatatttgatcagtctttttatgatctatcgctgcaaaccagtgaaatcaaagaagaagaaaaggaactgagaagaactacatataaactacaagtcaaaaatgaagaggtaaagaatatgtcacttgaactcaactcaaaacttgaaagcctcctagaagaaaaaattctacttcaacaaaaagtgaaatatttagaagagcaactaactaacttaattcaaaatcaacctgaaactccagaacacccagaagtaacttcacttaaaacttttgtagaaaaacaagataatagcatcaaagaccttctccagaccgtggaagaccaatataaacaattaaaccaacagcatagtcaaataaaagaaatagaaaatcagctcagaaggactagtattcaagaacccacagaaatttctctatcttccaagccaagagcaccaagaactactccctttcttcagttgaatgaaataagaaatgtaaaacatgatggcattcctgctgaatgtaccaccatttataacagaggtgaacatacaagtggcatgtatgccatcagacccagcaactctcaagtttttcatgtctactgtgatgttatatcaggtagtccatggacattaattcaacatcgaatagatggatcacaaaacttcaatgaaacgtgggagaactacaaatatggttttgggaggcttgatggagaattttggttgggcctagagaagatatactccatagtgaagcaatctaattatgttttacgaattgagttggaagactggaaagacaacaaacattatattgaatattctttttacttgggaaatcacgaaaccaactatacgctacatctagttgcgattactggcaatgtccccaatgcaatcccggaaaacaaagatttggtgttttctacttgggatcacaaagcaaaaggacacttcaactgtccagagggttattcaggaggctggtggtggcatgatgagtgtggagaaaacaacctaaatggtaaatataacaaaccaagagcaaaatctaagccagagaggagaagaggattatcttggaagtctcaaaatggaaggttatactctataaaatcaaccaaaatgttgatccatccaacagattcagaaagctttgaatgaactgaggcaaatttaaaaggcaataatttaaacattaacctcattccaagttaatgtggtctaataatctggtattaaatccttaagagaaagcttgagaaatagattttttttatcttaaagtcactgtctatttaagattaaacatacaatcacataaccttaaagaataccgtttacatttctcaatcaaaattcttataatactatttgttttaaattttgtgatgtgggaatcaattttagatggtcacaatctagattataatcaataggtgaacttattaaataacttttctaaataaaaaatttagagacttttattttaaaaggcatcatatgagctaatatcacaactttcccagtttaaaaaactagtactcttgttaaaactctaaacttgactaaatacagaggactggtaattgtacagttcttaaatgttgtagtattaatttcaaaactaaaaatcgtcagcacagagtatgtgtaaaaatctgtaatacaaatttttaaactgatgcttcattttgctacaaaataatttggagtaaatgtttgatatgatttatttatgaaacctaatgaagcagaattaaatactgtattaaaataagttcgctgtctttaaacaaatggagatgactactaagtcacattgactttaacatgaggtatcactataccttatttgttaaaatatatactgtatacattttatatattttaacacttaatactatgaaaacaaataattgtaaaggaatcttgtcagattacagtaagaatgaacatatttgtggcatcgagttaaagtttatatttcccctaaatatgctgtgattctaatacattcgtgtaggttttcaagtagaaataaacctcgtaacaagttactgaacgtttaaacagcctgacaagcatgtatatatgtttaaaattcaataaacaaagacccagtccctaaattatagaaatttaaattattcttgcatgtttatcgacatcacaacagatccctaaatccctaaatccctaaagattagatacaaattttttaccacagtatcacttgtcagaatttatttttaaatatgattttttaaaactgccagtaagaaattttaaattaaacccatttgttaaaggatatagtgcccaagttatatggtgacctacctttgtcaatacttagcattatgtatttcaaattatccaatatacatgtcatatatatttttatatgtcacatatataaaagatatgtatgatctatgtgaatcctaagtaaatattttgttccagaaaagtacaaaataataaaggtaaaaataatctataattttcaggaccacagactaagctgtcgaaattaacgctgatttttttagggccagaataccaaaatggctcctctcttcccccaaaattggacaatttcaaatgcaaaataattcattatttaatatatgagttgcttcctctatt

SEQ ID NO: 2 - DNA, 2951 bp, Homo sapiens
  source 1..2951: mol_type = genomic DNA
aatagaggaagcaactcatatattaaataatgaattattttgcatttgaaattgtccaattttgggggaagagaggagccattttggtattctggccctaaaaaaatcagcgttaatttcgacagcttagtctgtggtcctgaaaattatagattatttttacctttattattttgtacttttctggaacaaaatatttacttaggattcacatagatcatacatatcttttatatatgtgacatataaaaatatatatgacatgtatattggataatttgaaatacataatgctaagtattgacaaaggtaggtcaccatataacttgggcactatatcctttaacaaatgggtttaatttaaaatttcttactggcagttttaaaaaatcatatttaaaaataaattctgacaagtgatactgtggtaaaaaatttgtatctaatctttagggatttagggatttagggatctgttgtgatgtcgataaacatgcaagaataatttaaatttctataatttagggactgggtctttgtttattgaattttaaacatatatacatgcttgtcaggctgtttaaacgttcagtaacttgttacgaggtttatttctacttgaaaacctacacgaatgtattagaatcacagcatatttaggggaaatataaactttaactcgatgccacaaatatgttcattcttactgtaatctgacaagattcctttacaattatttgttttcatagtattaagtgttaaaatatataaaatgtatacagtatatattttaacaaataaggtatagtgatacctcatgttaaagtcaatgtgacttagtagtcatctccatttgtttaaagacagcgaacttattttaatacagtatttaattctgcttcattaggtttcataaataaatcatatcaaacatttactccaaattattttgtagcaaaatgaagcatcagtttaaaaatttgtattacagatttttacacatactctgtgctgacgatttttagttttgaaattaatactacaacatttaagaactgtacaattaccagtcctctgtatttagtcaagtttagagttttaacaagagtactagttttttaaactgggaaagttgtgatattagctcatatgatgccttttaaaataaaagtctctaaattttttatttagaaaagttatttaataagttcacctattgattataatctagattgtgaccatctaaaattgattcccacatcacaaaatttaaaacaaatagtattataagaattttgattgagaaatgtaaacggtattctttaaggttatgtgattgtatgtttaatcttaaatagacagtgactttaagataaaaaaaatctatttctcaagctttctcttaaggatttaataccagattattagaccacattaacttggaatgaggttaatgtttaaattattgccttttaaatttgcctcagttcattcaaagctttctgaatctgttggatggatcaacattttggttgattttatagagtataaccttccattttgagacttccaagataatcctcttctcctctctggcttagattttgctcttggtttgttatatttaccatttaggttgttttctccacactcatcatgccaccaccagcctcctgaataaccctctggacagttgaagtgtccttttgctttgtgatcccaagtagaaaacaccaaatctttgttttccgggattgcattggggacattgccagtaatcgcaactagatgtagcgtatagttggtttcgtgatttcccaagtaaaaagaatattcaatataatgtttgttgtctttccagtcttccaactcaattcgtaaaacataattagattgcttcactatggagtatatcttctctaggcccaaccaaaattctccatcaagcctcccaaaaccatatttgtagttctcccacgtttcattgaagttttgtgatccatctattcgatgttgaattaatgtccatggactacctgatataacatcacagtagacatgaaaaacttgagagttgctgggtctgatggcatacatgccacttgtatgttcacctctgttataaatggtggtacattcagcaggaatgccatcatgttttacatttcttatttcattcaactgaagaaagggagtagttcttggtgctcttggcttggaagatagagaaatttctgtgggttcttgaatactagtccttctgagctgattttctatttcttttatttgactatgctgttggtttaattgtttatattggtcttccacggtctggagaaggtctttgatgctattatcttgtttttctacaaaagttttaagtgaagttacttctgggtgttctggagtttcaggttgattttgaattaagttagttagttgctcttctaaatatttcactttttgttgaagtagaattttttcttctaggaggctttcaagttttgagttgagttcaagtgacatattctttacctcttcatttttgacttgtagtttatatgtagttcttctcagttccttttcttcttctttgatttcactggtttgcagcgatagatcataaaaagactgatcaaatatgttgagtttttgaaatatgtcattaatttggcccttcgtcttatggacaaagtctttaagaccatgtcccaactgaaggaggccattggctaaaatttttacatcgtctaacatagcaaatcttgattttggctctggagatagagaatcaaatgatgaattgtcttgatcaattctggaggaaataactagaggaacaataaaaagaaggagcttaattgtgaacatttttatcttgattttcaatttcaagcaacgtggaactgttttcttctggaagcagacctagacttcttaactctatatat

SEQ ID NO: 3 - DNA, 2126 bp, Homo sapiens
  source 1..2126: mol_type = genomic DNA
ttccagaagaaaacagttccacgttgcttgaaattgaaaatcaagataaaaatgttcacaattaagctccttctttttattgttcctctagttatttcctccagaattgatcaagacaattcatcatttgattctctatctccagagccaaaatcaagatttgctatgttagacgatgtaaaaattttagccaatggcctccttcagttgggacatggtcttaaagactttgtccataagacgaagggccaaattaatgacatatttcaaaaactcaacatatttgatcagtctttttatgatctatcgctgcaaaccagtgaaatcaaagaagaagaaaaggaactgagaagaactacatataaactacaagtcaaaaatgaagaggtaaagaatatgtcacttgaactcaactcaaaacttgaaagcctcctagaagaaaaaattctacttcaacaaaaagtgaaatatttagaagagcaactaactaacttaattcaaaatcaacctgaaactccagaacacccagaagtaacttcacttaaaacttttgtagaaaaacaagataatagcatcaaagaccttctccagaccgtggaagaccaatataaacaattaaaccaacagcatagtcaaataaaagaaatagaaaatcagctcagaaggactagtattcaagaacccacagaaatttctctatcttccaagccaagagcaccaagaactactccctttcttcagttgaatgaaataagaaatgtaaaacatgatggcattcctgctgaatgtaccaccatttataacagaggtgaacatacaagtggcatgtatgccatcagacccagcaactctcaagtttttcatgtctactgtgatgttatatcaggtagtccatggacattaattcaacatcgaatagatggatcacaaaacttcaatgaaacgtgggagaactacaaatatggttttgggaggcttgatggagaattttggttgggcctagagaagatatactccatagtgaagcaatctaattatgttttacgaattgagttggaagactggaaagacaacaaacattatattgaatattctttttacttgggaaatcacgaaaccaactatacgctacatctagttgcgattactggcaatgtccccaatgcaatcccggaaaacaaagatttggtgttttctacttgggatcacaaagcaaaaggacacttcaactgtccagagggttattcaggaggctggtggtggcatgatgagtgtggagaaaacaacctaaatggtaaatataacaaaccaagagcaaaatctaagccagagaggagaagaggattatcttggaagtctcaaaatggaaggttatactctataaaatcaaccaaaatgttgatccatccaacagattcagaaagctttgaatgaactgaggcaaatttaaaaggcaataatttaaacattaacctcattccaagttaatgtggtctaataatctggtattaaatccttaagagaaagcttgagaaatagattttttttatcttaaagtcactgtctatttaagattaaacatacaatcacataaccttaaagaataccgtttacatttctcaatcaaaattcttataatactatttgttttaaattttgtgatgtgggaatcaattttagatggtcacaatctagattataatcaataggtgaacttattaaataacttttctaaataaaaaatttagagacttttattttaaaaggcatcatatgagctaatatcacaactttcccagtttaaaaaactagtactcttgttaaaactctaaacttgactaaatacagaggactggtaattgtacagttcttaaatgttgtagtattaatttcaaaactaaaaatcgtcagcacagagtatgtgtaaaaatctgtaatacaaatttttaaactgatgcttcattttgctacaaaataatttggagtaaatgtttgatatgatttatttatgaaacctaatgaagcagaattaaatactgtattaaaataagttcgctgtctttaaacaaatggagatgactactaagtcacattgactttaacatgaggtatcactataccttatt

SEQ ID NO: 4 - DNA, 2126 bp, Homo sapiens
  source 1..2126: mol_type = genomic DNA
aataaggtatagtgatacctcatgttaaagtcaatgtgacttagtagtcatctccatttgtttaaagacagcgaacttattttaatacagtatttaattctgcttcattaggtttcataaataaatcatatcaaacatttactccaaattattttgtagcaaaatgaagcatcagtttaaaaatttgtattacagatttttacacatactctgtgctgacgatttttagttttgaaattaatactacaacatttaagaactgtacaattaccagtcctctgtatttagtcaagtttagagttttaacaagagtactagttttttaaactgggaaagttgtgatattagctcatatgatgccttttaaaataaaagtctctaaattttttatttagaaaagttatttaataagttcacctattgattataatctagattgtgaccatctaaaattgattcccacatcacaaaatttaaaacaaatagtattataagaattttgattgagaaatgtaaacggtattctttaaggttatgtgattgtatgtttaatcttaaatagacagtgactttaagataaaaaaaatctatttctcaagctttctcttaaggatttaataccagattattagaccacattaacttggaatgaggttaatgtttaaattattgccttttaaatttgcctcagttcattcaaagctttctgaatctgttggatggatcaacattttggttgattttatagagtataaccttccattttgagacttccaagataatcctcttctcctctctggcttagattttgctcttggtttgttatatttaccatttaggttgttttctccacactcatcatgccaccaccagcctcctgaataaccctctggacagttgaagtgtccttttgctttgtgatcccaagtagaaaacaccaaatctttgttttccgggattgcattggggacattgccagtaatcgcaactagatgtagcgtatagttggtttcgtgatttcccaagtaaaaagaatattcaatataatgtttgttgtctttccagtcttccaactcaattcgtaaaacataattagattgcttcactatggagtatatcttctctaggcccaaccaaaattctccatcaagcctcccaaaaccatatttgtagttctcccacgtttcattgaagttttgtgatccatctattcgatgttgaattaatgtccatggactacctgatataacatcacagtagacatgaaaaacttgagagttgctgggtctgatggcatacatgccacttgtatgttcacctctgttataaatggtggtacattcagcaggaatgccatcatgttttacatttcttatttcattcaactgaagaaagggagtagttcttggtgctcttggcttggaagatagagaaatttctgtgggttcttgaatactagtccttctgagctgattttctatttcttttatttgactatgctgttggtttaattgtttatattggtcttccacggtctggagaaggtctttgatgctattatcttgtttttctacaaaagttttaagtgaagttacttctgggtgttctggagtttcaggttgattttgaattaagttagttagttgctcttctaaatatttcactttttgttgaagtagaattttttcttctaggaggctttcaagttttgagttgagttcaagtgacatattctttacctcttcatttttgacttgtagtttatatgtagttcttctcagttccttttcttcttctttgatttcactggtttgcagcgatagatcataaaaagactgatcaaatatgttgagtttttgaaatatgtcattaatttggcccttcgtcttatggacaaagtctttaagaccatgtcccaactgaaggaggccattggctaaaatttttacatcgtctaacatagcaaatcttgattttggctctggagatagagaatcaaatgatgaattgtcttgatcaattctggaggaaataactagaggaacaataaaaagaaggagcttaattgtgaacatttttatcttgattttcaatttcaagcaacgtggaactgttttcttctggaa

SEQ ID NO: 5 - DNA, 1598 bp, Mus musculus
  source 1..1598: mol_type = genomic DNA
caggagggagaagttccaaattgcttaaaattgaataattgagacaaaaaatgcacacaattaaattattcctttttgttgttcctttagtaattgcatccagagtggatccagacctttcatcatttgattctgcaccttcagagccaaaatcaagatttgctatgttggatgatgtcaaaattttagcgaatggcctcctgcagctgggtcatggacttaaagattttgtccataagactaagggacaaattaacgacatatttcagaagctcaacatatttgatcagtctttttatgacctatcacttcgaaccaatgaaatcaaagaagaggaaaaggagctaagaagaactacatctacactacaagttaaaaacgaggaggtgaagaacatgtcagtagaactgaactcaaagcttgagagtctgctggaagagaagacagcccttcaacacaaggtcagggctttggaggagcagctaaccaacttaattctaagcccagctggggctcaggagcacccagaagtaacatcactcaaaagttttgtagaacagcaagacaacagcataagagaactcctccagagtgtggaagaacagtataaacaattaagtcaacagcacatgcagataaaagaaatagaaaagcagctcagaaagactggtattcaagaaccctcagaaaattctctttcttctaaatcaagagcaccaagaactactccccctcttcaactgaacgaaacagaaaatacagaacaagatgaccttcctgccgactgctctgccgtttataacagaggcgaacatacaagtggcgtgtacactattaaaccaagaaactcccaagggtttaatgtctactgtgatacccaatcaggcagtccatggacattaattcaacaccggaaagatggctcacaggacttcaacgaaacatgggaaaactacgaaaagggctttgggaggctcgatggagaattttggttgggcctagagaagatctatgctatagtccaacagtctaactacattttacgactcgagctacaagactggaaagacagcaagcactacgttgaatactcctttcacctgggcagtcacgaaaccaactacacgctacatgtggctgagattgctggcaatatccctggggccctcccagagcacacagacctgatgttttctacatggaatcacagagcaaagggacagctctactgtccagaaagttactcaggtggctggtggtggaatgacatatgtggagaaaacaacctaaatggaaaatacaacaaacccagaaccaaatccagaccagagagaagaagagggatctactggagacctcagagcagaaagctctatgctatcaaatcatccaaaatgatgctccagcccaccacctaagaagcttcaactgaactgagacaaaataaaagatcaataaattaaatattaaagtcctcccgatcactgtagtaatctggtattaaaattttaatggaaagcttgagaattgaatttcaattaggtttaaactcattgttaagatcagatatcaccgaatcaacgtaaacaaaatttatc

SEQ ID NO: 6 - DNA, 1598 bp, Mus musculus; identical to SEQ ID NO: 5
  source 1..1598: mol_type = genomic DNA

SEQ ID NO: 7 - DNA, 1785 bp, Rattus norvegicus
  source 1..1785: mol_type = genomic DNA
gacgttccaaattgcttgaaattgaataattgaaacaaaaatgcacacaattaagctgctcctttttgttgttcctctagtaatttcgtccagagttgatccagacctttcgccatttgattctgtaccgtcagagccaaaatcaagatttgctatgttggatgatgtcaaaattttagccaatggcctcctgcagctgggtcatggtcttaaagattttgtccataagacaaagggacaaattaatgacatatttcagaagctcaacatatttgatcagtgtttttatgacctatcacttcaaaccaatgaaatcaaagaagaggaaaaggagctaagaagaaccacatctaaactacaagttaaaaacgaagaggtgaagaatatgtcacttgaactgaactcaaagcttgaaagtctactggaggagaagatggcgctccaacacagagtcagggctttggaggaacagctgaccagcttggttcagaacccgcctggggctcgggagcacccagaggtaacgtcacttaaaagttttgtagaacagcaagataacagcataagagaactcctccagagtgtggaagaacaatataaacaactaagtcaacagcacattcagataaaagaaatagaaaatcagctcagaaagactggcattcaagaacccactgaaaattctctttattctaaaccaagagcaccaagaactactccccctcttcatctgaaggaagcaaaaaatatagaacaagatgatctgcctgctgactgctctgccatttataacagaggtgaacatacaagtggcgtgtatactattagaccaagcagctctcaagtgtttaatgtctactgtgacacccaatcaggcactccacggacattaattcaacaccggaaagatggctctcaaaacttcaaccaaacgtgggaaaactacgaaaagggttttgggaggcttgatggtaaagtgatttccttgcatcactcacttatctgttgatttaatagtattagttgggtgtgttgacacaggcctgagaccatagcgcttttgggcaaggggggaggaggagcagcaggtgaattgaaagttcaagaccagtctgggccacacattgatactccttctcgacattaagaattataaattaagcagcaattataaaatgggctgtggaaatgtaacaataagcaaaagcagaccccagtcttcataaaactgattggtaaatattatccatgatagcaactgcaatgatctcattgtacttatcactactgcatgcctgcagtatgcttgttgaaacttaattctatagttcatggttatcataagtcttattaaggaacatagtatacgccattggctctagtgaggggccatgctacaaatgagctgcaaagatagcagtatagagctctttcagtgatatcctaagcacaacgtaacacaggtgaaatgggctggaggcacagttgtggtggaacacgcggccagcaggacactgggactgatccccagcagcacaaagaaagtgataggaacacagagcgagagttagaagggacagggtcaccgtcagagatacggtgtctaactcctgcaaccctacctgtaattattccatattataaacatatactatataactgtgggtctctgcatgttctagaatatgaattctatttgattgtaaaacaaaactataaaaataagtaaaaaaataaaaaataaacagatacttaaaatcaaaaaaaaaaaaaaaaaaaaaaaaa

SEQ ID NO: 8 - DNA, 1785 bp, Rattus norvegicus
  source 1..1785: mol_type = genomic DNA
tttttttttttttttttttttttttgattttaagtatctgtttattttttatttttttacttatttttatagttttgttttacaatcaaatagaattcatattctagaacatgcagagacccacagttatatagtatatgtttataatatggaataattacaggtagggttgcaggagttagacaccgtatctctgacggtgaccctgtcccttctaactctcgctctgtgttcctatcactttctttgtgctgctggggatcagtcccagtgtcctgctggccgcgtgttccaccacaactgtgcctccagcccatttcacctgtgttacgttgtgcttaggatatcactgaaagagctctatactgctatctttgcagctcatttgtagcatggcccctcactagagccaatggcgtatactatgttccttaataagacttatgataaccatgaactatagaattaagtttcaacaagcatactgcaggcatgcagtagtgataagtacaatgagatcattgcagttgctatcatggataatatttaccaatcagttttatgaagactggggtctgcttttgcttattgttacatttccacagcccattttataattgctgcttaatttataattcttaatgtcgagaaggagtatcaatgtgtggcccagactggtcttgaactttcaattcacctgctgctcctcctccccccttgcccaaaagcgctatggtctcaggcctgtgtcaacacacccaactaatactattaaatcaacagataagtgagtgatgcaaggaaatcactttaccatcaagcctcccaaaacccttttcgtagttttcccacgtttggttgaagttttgagagccatctttccggtgttgaattaatgtccgtggagtgcctgattgggtgtcacagtagacattaaacacttgagagctgcttggtctaatagtatacacgccacttgtatgttcacctctgttataaatggcagagcagtcagcaggcagatcatcttgttctatattttttgcttccttcagatgaagagggggagtagttcttggtgctcttggtttagaataaagagaattttcagtgggttcttgaatgccagtctttctgagctgattttctatttcttttatctgaatgtgctgttgacttagttgtttatattgttcttccacactctggaggagttctcttatgctgttatcttgctgttctacaaaacttttaagtgacgttacctctgggtgctcccgagccccaggcgggttctgaaccaagctggtcagctgttcctccaaagccctgactctgtgttggagcgccatcttctcctccagtagactttcaagctttgagttcagttcaagtgacatattcttcacctcttcgtttttaacttgtagtttagatgtggttcttcttagctccttttcctcttctttgatttcattggtttgaagtgataggtcataaaaacactgatcaaatatgttgagcttctgaaatatgtcattaatttgtccctttgtcttatggacaaaatctttaagaccatgacccagctgcaggaggccattggctaaaattttgacatcatccaacatagcaaatcttgattttggctctgacggtacagaatcaaatggcgaaaggtctggatcaactctggacgaaattactagaggaacaacaaaaaggagcagcttaattgtgtgcatttttgtttcaattattcaatttcaagcaatttggaacgtc

SEQ ID NO: 9 - DNA, 2995 bp, Macaca fascicularis
  source 1..2995: mol_type = genomic DNA
tacaatttcaaattacctattaagttagttgctcatttctttgatttcatttagcattgatgtaactcaatgtggaagaaggttacattcgtgcaagttaacatggcttaatgattaactatattcacctgccaaccttgccttttctgtggcaaatattggtatatatagagttaagaagtctaggtctgcttccagaagaacacagttccacgctgcttgaaattgaaaatcaggataaaaatgttcacaattaagctccttctttttattgttcctctagttatttcctccagaattgaccaagacaattcatcatttgattctgtatctccagagccaaaatcaagatttgctatgttagacgatgtaaaaattttagccaatggcctccttcagttgggacatggtcttaaagactttgtccataagactaagggccaaattaatgacatatttcaaaaactcaacatatttgatcagtctttttatgatctatcactgcaaaccagtgaaatcaaagaagaagaaaaggaactgagaagaactacatataaactacaagtcaaaaatgaagaggtaaagaatatgtcacttgaactcaactcaaaacttgaaagcctcctagaagaaaaaattctacttcaacaaaaagtgaaatatttagaagagcaactaactaacttaattcaaaatcaacctgcaactccagaacatccagaagtaacttcacttaaaagttttgtagaaaaacaagataatagcatcaaagaccttctccagactgtggaagaacaatataagcaattaaaccaacagcatagtcaaataaaagaaatagaaaatcagctcagaatgactaatattcaagaacccacagaaatttctctatcttccaagccaagagcaccaagaactactccctttcttcagctgaatgaaataagaaatgtaaaacatgatggcattcctgctgattgtaccaccatttacaatagaggtgaacatataagtggcacgtatgccatcagacccagcaactctcaagtttttcatgtctactgtgatgttgtatcaggtagtccatggacattaattcaacatcgaatagatggatcacaaaacttcaatgaaacgtgggagaactacaaatatggtttcgggaggcttgatggagaattctggttgggcctagagaagatatactccatagtgaagcaatctaattacgttttacgaattgagttggaagactggaaagacaacaaacattatattgaatattctttttacttgggaaatcacgaaaccaactatacgctacatgtagttaagattactggcaatgtccccaatgcaatcccggaaaacaaagatttggtgttttctacttgggatcacaaagcaaaaggacacttcagctgtccagagagttattcaggaggctggtggtggcatgatgagtgtggagaaaacaacctaaatggtaaatataacaaaccaagaacaaaatctaagccagagcggagaagaggattatcctggaagtctcaaaatggaaggttatactctataaaatcaaccaaaatgttgatccatccaacagattcagaaagctttgaatgaactgaggcaaatttaaaaggcaataaattaaacattaaactcattccaagttaatgtggtttaataatctggtattaaatccttaagagaaggcttgagaaatagatttttttatcttaaagtcactgtcaatttaagattaaacatacaatcacataaccttaaagaataccatttacatttctcaatcaaaattcttacaacactatttgttttatattttgtgatgtgggaatcaattttagatggtcgcaatctaaattataatcaacaggtgaacttactaaataacttttctaaataaaaaacttagagactttaattttaaaagtcatcatatgagctaatatcacaattttcccagtttaaaaaactagttttcttgttaaaactctaaacttgactaaataaagaggactgataattatacagttcttaaatttgttgtaatattaatttcaaaactaaaaattgtcagcacagagtatgtgtaaaaatctgtaatataaatttttaaactgatgcctcattttgctacaaaataatctggagtaaatttttgataggatttatttatgaaacctaatgaagcaggattaaatactgtattaaaataggttcgctgtcttttaaacaaatggagatgatgattactaagtcacattgactttaatatgaggtatcactataccttaacatatttgttaaaacgtatactgtatacattttgtgtattttaatacttaatactatgaaaacaagtaattgtaaacgtatcttgtcagattacaataggaatgaacatattggtgacatcgagttaaagtttatatttcccctaaatatgctgcgattccaatatattcatgtaggttttcaagcagaaataaaccttgtaacaagttactgactaaacagcctgacaagtatgtatatatgtttaaaattcaataaataaagacccagtcttctaaattataaaaatttaaattagtcttgcacaaattaaattattcatcacaaaagatgtattgttatttttaagtcatttaagccctaaatccctaaagattagatataaattttttttgccagagtataaattgtcagaatttatttttaaatatattttttaaaactaccagtaagaaattttaaattaaacccatttgttaaaggatatagtgcccaagttatacggtgacctacctttgtcaatatttagcattatgtatttcaaattatccaatatacatgtcatatatatttttatatgttgcatatataaaagatatacacgatttatgtgaatcctatgtaaatattttgttccagaaaagtacaaaataataaaggtaaaaataatcca

SEQ ID NO: 10 - DNA, 2995 bp, Macaca fascicularis
  source 1..2995: mol_type = genomic DNA
tggattatttttacctttattattttgtacttttctggaacaaaatatttacataggattcacataaatcgtgtatatcttttatatatgcaacatataaaaatatatatgacatgtatattggataatttgaaatacataatgctaaatattgacaaaggtaggtcaccgtataacttgggcactatatcctttaacaaatgggtttaatttaaaatttcttactggtagttttaaaaaatatatttaaaaataaattctgacaatttatactctggcaaaaaaaatttatatctaatctttagggatttagggcttaaatgacttaaaaataacaatacatcttttgtgatgaataatttaatttgtgcaagactaatttaaatttttataatttagaagactgggtctttatttattgaattttaaacatatatacatacttgtcaggctgtttagtcagtaacttgttacaaggtttatttctgcttgaaaacctacatgaatatattggaatcgcagcatatttaggggaaatataaactttaactcgatgtcaccaatatgttcattcctattgtaatctgacaagatacgtttacaattacttgttttcatagtattaagtattaaaatacacaaaatgtatacagtatacgttttaacaaatatgttaaggtatagtgatacctcatattaaagtcaatgtgacttagtaatcatcatctccatttgtttaaaagacagcgaacctattttaatacagtatttaatcctgcttcattaggtttcataaataaatcctatcaaaaatttactccagattattttgtagcaaaatgaggcatcagtttaaaaatttatattacagatttttacacatactctgtgctgacaatttttagttttgaaattaatattacaacaaatttaagaactgtataattatcagtcctctttatttagtcaagtttagagttttaacaagaaaactagttttttaaactgggaaaattgtgatattagctcatatgatgacttttaaaattaaagtctctaagttttttatttagaaaagttatttagtaagttcacctgttgattataatttagattgcgaccatctaaaattgattcccacatcacaaaatataaaacaaatagtgttgtaagaattttgattgagaaatgtaaatggtattctttaaggttatgtgattgtatgtttaatcttaaattgacagtgactttaagataaaaaaatctatttctcaagccttctcttaaggatttaataccagattattaaaccacattaacttggaatgagtttaatgtttaatttattgccttttaaatttgcctcagttcattcaaagctttctgaatctgttggatggatcaacattttggttgattttatagagtataaccttccattttgagacttccaggataatcctcttctccgctctggcttagattttgttcttggtttgttatatttaccatttaggttgttttctccacactcatcatgccaccaccagcctcctgaataactctctggacagctgaagtgtccttttgctttgtgatcccaagtagaaaacaccaaatctttgttttccgggattgcattggggacattgccagtaatcttaactacatgtagcgtatagttggtttcgtgatttcccaagtaaaaagaatattcaatataatgtttgttgtctttccagtcttccaactcaattcgtaaaacgtaattagattgcttcactatggagtatatcttctctaggcccaaccagaattctccatcaagcctcccgaaaccatatttgtagttctcccacgtttcattgaagttttgtgatccatctattcgatgttgaattaatgtccatggactacctgatacaacatcacagtagacatgaaaaacttgagagttgctgggtctgatggcatacgtgccacttatatgttcacctctattgtaaatggtggtacaatcagcaggaatgccatcatgttttacatttcttatttcattcagctgaagaaagggagtagttcttggtgctcttggcttggaagatagagaaatttctgtgggttcttgaatattagtcattctgagctgattttctatttcttttatttgactatgctgttggtttaattgcttatattgttcttccacagtctggagaaggtctttgatgctattatcttgtttttctacaaaacttttaagtgaagttacttctggatgttctggagttgcaggttgattttgaattaagttagttagttgctcttctaaatatttcactttttgttgaagtagaattttttcttctaggaggctttcaagttttgagttgagttcaagtgacatattctttacctcttcatttttgacttgtagtttatatgtagttcttctcagttccttttcttcttctttgatttcactggtttgcagtgatagatcataaaaagactgatcaaatatgttgagtttttgaaatatgtcattaatttggcccttagtcttatggacaaagtctttaagaccatgtcccaactgaaggaggccattggctaaaatttttacatcgtctaacatagcaaatcttgattttggctctggagatacagaatcaaatgatgaattgtcttggtcaattctggaggaaataactagaggaacaataaaaagaaggagcttaattgtgaacatttttatcctgattttcaatttcaagcagcgtggaactgtgttcttctggaagcagacctagacttcttaactctatatataccaatatttgccacagaaaaggcaaggttggcaggtgaatatagttaatcattaagccatgttaacttgcacgaatgtaaccttcttccacattgagttacatcaatgctaaatgaaatcaaagaaatgagcaactaacttaataggtaatttgaaattgta

SEQ ID NO: 11 - DNA, 2149 bp, Macaca mulatta
  source 1..2149: mol_type = genomic DNA
atatatagagttaagaagtctaggtctgcttccagaagaacacagttccacgttgcttgaaattgaaaatcaggataaaaatgttcacaattaagctccttctttttattgttcctctagttatttcctccagaattgaccaagacaattcatcatttgattctgtatctccagagccaaaatcaagatttgctatgttagacgatgtaaaaattttagccaatggcctccttcagttgggacatggtcttaaagactttgtccataagactaagggccaaattaatgacatatttcaaaaactcaacatatttgatcagtctttttatgatctatcactgcaaaccagtgaaatcaaagaagaagaaaaggaactgagaagaactacatataaactacaagtcaaaaatgaagaggtaaagaatatgtcacttgaactcaactcaaaacttgaaagcctcctagaagaaaaaattctacttcaacaaaaagtgaaatatttagaagagcaactaactaacttaattcaaaatcaacctgaaactccagaacatccagaagtaacttcacttaaaagttttgtagaaaaacaagataatagcatcaaagaccttctccagactgtggaagaacaatataagcaattaaaccaacagcacagtcaaataaaagaaatagaaaatcagctcagaatgactaatattcaagaacccacagaaatttctctatcttccaagccaagagcaccaagaactactccctttcttcagctgaatgaaataagaaatgtaaaacatgatggcattcctgctgattgtaccaccatttacaatagaggtgaacatataagtggcatgtatgccatcagacccagcaactctcaagtttttcatgtctactgtgatgttgtatcaggtaaaacctgtctaaggagaatagatggatcacaaaacttcaatgaaacgtgggagaactacaaatatggtttcgggaggcttgatggagaattctggttgggcctagagaagatatactccatagtgaagcaatctaattacgttttacgaattgagttggaagactggaaagacaacaaacattatattgaatattctttttacttgggaaatcacgaaaccaactatacgctacatgtagttaagattactggcaatgtccccaatgcaatcccggaaaacaaagatttggtgttttctacttgggatcacaaagcaaaaggacacttcagctgtccagagagttattcaggaggctggtggtggcatgatgagtgtggagaaaacaacctaaatggtaaatataacaaaccaagaacaaaatctaagccagagcggagaagaggattatcctggaagtctcaaaatggaaggttatactctataaaatcaaccaaaatgttgatccatccaacagattcagaaagctttgaatgaactgaggcaaatttaaaaggcaataaattaaacattaaactcattccaagttaatgtggtttaataatctggtattaaatccttaagagaaggcttgagaaatagatttttttatcttaaagtcactgtcaatttaagattaaacatacaatcacataaccttaaagaataccatttacatttctcaatcaaaattcctacaacactatttgttttatattttgtgatgtgggaatcaattttagatggtcgcaatctaaattataatcaacaggtgaacttactaaataacttttctaaataaaaaacttagagactttaattttaaaagtcatcatatgagctaatatcacaattttcccagtttaaaaaactagttttcttgttaaaactctaaacttgactaaataaagaggactgataattatacagttcttaaatttgttgtaatattaatttcaaaactaaaaattgtcagcacagagtatgtgtaaaaatctgtaatataaatttttaaactgatgcctcattttgctacaaaataatctggagtaaatttttgataggatttatttatgaaacctaatgaagcaggattaaatactgtattaaaataggttcgctgtcttttaaacaaatggagatgatgattactaagtcacattgactttaatatgaggtatcactatacctta

SEQ ID NO: 12 - DNA, 2149 bp, Macaca mulatta
  source 1..2149: mol_type = genomic DNA
taaggtatagtgatacctcatattaaagtcaatgtgacttagtaatcatcatctccatttgtttaaaagacagcgaacctattttaatacagtatttaatcctgcttcattaggtttcataaataaatcctatcaaaaatttactccagattattttgtagcaaaatgaggcatcagtttaaaaatttatattacagatttttacacatactctgtgctgacaatttttagttttgaaattaatattacaacaaatttaagaactgtataattatcagtcctctttatttagtcaagtttagagttttaacaagaaaactagttttttaaactgggaaaattgtgatattagctcatatgatgacttttaaaattaaagtctctaagttttttatttagaaaagttatttagtaagttcacctgttgattataatttagattgcgaccatctaaaattgattcccacatcacaaaatataaaacaaatagtgttgtaggaattttgattgagaaatgtaaatggtattctttaaggttatgtgattgtatgtttaatcttaaattgacagtgactttaagataaaaaaatctatttctcaagccttctcttaaggatttaataccagattattaaaccacattaacttggaatgagtttaatgtttaatttattgccttttaaatttgcctcagttcattcaaagctttctgaatctgttggatggatcaacattttggttgattttatagagtataaccttccattttgagacttccaggataatcctcttctccgctctggcttagattttgttcttggtttgttatatttaccatttaggttgttttctccacactcatcatgccaccaccagcctcctgaataactctctggacagctgaagtgtccttttgctttgtgatcccaagtagaaaacaccaaatctttgttttccgggattgcattggggacattgccagtaatcttaactacatgtagcgtatagttggtttcgtgatttcccaagtaaaaagaatattcaatataatgtttgttgtctttccagtcttccaactcaattcgtaaaacgtaattagattgcttcactatggagtatatcttctctaggcccaaccagaattctccatcaagcctcccgaaaccatatttgtagttctcccacgtttcattgaagttttgtgatccatctattctccttagacaggttttacctgatacaacatcacagtagacatgaaaaacttgagagttgctgggtctgatggcatacatgccacttatatgttcacctctattgtaaatggtggtacaatcagcaggaatgccatcatgttttacatttcttatttcattcagctgaagaaagggagtagttcttggtgctcttggcttggaagatagagaaatttctgtgggttcttgaatattagtcattctgagctgattttctatttcttttatttgactgtgctgttggtttaattgcttatattgttcttccacagtctggagaaggtctttgatgctattatcttgtttttctacaaaacttttaagtgaagttacttctggatgttctggagtttcaggttgattttgaattaagttagttagttgctcttctaaatatttcactttttgttgaagtagaattttttcttctaggaggctttcaagttttgagttgagttcaagtgacatattctttacctcttcatttttgacttgtagtttatatgtagttcttctcagttccttttcttcttctttgatttcactggtttgcagtgatagatcataaaaagactgatcaaatatgttgagtttttgaaatatgtcattaatttggcccttagtcttatggacaaagtctttaagaccatgtcccaactgaaggaggccattggctaaaatttttacatcgtctaacatagcaaatcttgattttggctctggagatacagaatcaaatgatgaattgtcttggtcaattctggaggaaataactagaggaacaataaaaagaaggagcttaattgtgaacatttttatcctgattttcaatttcaagcaacgtggaactgtgttcttctggaagcagacctagacttcttaactctatatat

SEQ ID NO: 13 - skipped

SEQ ID NO: 14 - protein, 16 aa, unidentified
  source 1..16: note = Description of Unknown: RFGF peptide sequence
AAVALLPAVLLALLAP

SEQ ID NO: 15 - protein, 11 aa, unidentified
  source 1..11: note = Description of Unknown: RFGF analogue peptide sequence
AALLPVLLAAP

SEQ ID NO: 16 - protein, 13 aa, Human immunodeficiency virus
GRKKRRQRRRPPQ

SEQ ID NO: 17 - protein, 16 aa, Drosophila sp.
RQIKIWFQNRRMKWKK

SEQ ID NO: 18 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-fluorouridine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate
aagctccttctttttattgtt

SEQ ID NO: 19 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-fluoroadenosine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aacaataaaaagaaggagcttgg

SEQ ID NO: 20 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-fluorouridine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note 2'-O-methyluridine-3'-phosphate-N-[tris(GalNAc-alkyl)-amido decanoyl)]-4-hydroxyprolinol (Hyp-(GalNAc-alkyl)3)
aagctccttctttttattgtt

SEQ ID NO: 21 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-fluorocytidine-3'-phosphate
  modified_base 8: mod_base = OTHER; note = 2'-O-methyluridine-3'-phosphate
  modified_base 9: mod_base = OTHER; note = 2'-fluorouridine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate
aagctccttctttttattgtt

SEQ ID NO: 22 - RNA, 23 nt, synthetic construct
  source 1..23: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-fluorouridine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-fluoroadenosine-3'-phosphate
  modified_base 15: mod_base = OTHER; note = 2'-O-methylguanosine-3'-phosphate
  modified_base 16: mod_base = OTHER; note = 2'-fluoroguanosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methyladenosine-3'- phosphorothioate
  modified_base 23: mod_base = OTHER; note = 2'-O-methyladenosine-3'-phosphate
aacaataaaaagaaggagcttaa

SEQ ID NO: 23 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methylguanosine-3'- phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = 2'-fluorouridine-3'-phosphate
  modified_base 8: mod_base = OTHER; note = 2'-O-methyluridine-3'-phosphate
  modified_base 9: mod_base = OTHER; note = 2'-fluorocytidine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate
agctccttctttttattgttt

SEQ ID NO: 24 - RNA, 23 nt, synthetic construct
  source 1..23: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-fluoroadenosine-3'-phosphate
  modified_base 7: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-fluoroadenosine-3'-phosphate
  modified_base 15: mod_base = OTHER; note = 2'-O-methyladenosine-3'-phosphate
  modified_base 16: mod_base = OTHER; note = 2'-fluoroguanosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyladenosine-3'-phosphate
aaacaataaaaagaaggagctta

SEQ ID NO: 25 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-fluorocytidine-3'-phosphate
  modified_base 8: mod_base = OTHER; note = 2'-O-methyluridine-3'-phosphate
  modified_base 9: mod_base = OTHER; note = 2'-fluorouridine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note 2'-O-methyluridine-3'-phosphate-N-[tris(GalNAc-alkyl)-amido decanoyl)]-4-hydroxyprolinol (Hyp-(GalNAc-alkyl)3)
aagctccttctttttattgtt

SEQ ID NO: 26 - RNA, 21 nt, Homo sapiens
  source 1..21: mol_type = genomic RNA
atttgctatgttagacgatgt

SEQ ID NO: 27 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylcytidine-3'-phosphate
  modified_base 2: mod_base = OTHER; note = 2'-O-methyluridine-3'-phosphate
  modified_base 3: mod_base = OTHER; note = 2'-O-methyluridine-3'-phosphate
  modified_base 5: mod_base = OTHER; note = 2'-O-methylcytidine-3'-phosphate
  modified_base 7: mod_base = OTHER; note = 2'-O-methylcytidine-3'-phosphate
  modified_base 8: mod_base = OTHER; note = 2'-O-methyluridine-3'-phosphate
  modified_base 12: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 20: mod_base = OTHER; note = 2'-deoxythimidine-3'-phosphorothioate
  misc_feature 1..19: note = RNA
  misc_feature 20..21: note = DNA
cttacgctgagtacttcgatt

SEQ ID NO: 28 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 7: mod_base = OTHER; note = 2'-O-methyluridine-3'-phosphate
  modified_base 11: mod_base = OTHER; note = 2'-O-methylcytidine-3'-phosphate
  modified_base 16: mod_base = OTHER; note = 2'-O-methyluridine-3'-phosphate
  modified_base 20: mod_base = OTHER; note = 2'-deoxythimidine-3'-phosphorothioate
  misc_feature 1..19: note = RNA
  misc_feature 20..21: note = DNA
tcgaagtactcagcgtaagtt

SEQ ID NO: 29 - RNA, 21 nt, synthetic construct
  source 1..21: mol_type = other RNA; note = Description of Artificial Sequence: Synthetic oligonucleotide
ataaaaatgttcacaattaat

SEQ ID NO: 30 - RNA, 21 nt, synthetic construct
  source 1..21: mol_type = other RNA; note = Description of Artificial Sequence: Synthetic oligonucleotide
taaaaatgttcacaattaagt

SEQ ID NO: 31 - RNA, 21 nt, synthetic construct
  source 1..21: mol_type = other RNA; note = Description of Artificial Sequence: Synthetic oligonucleotide
aaaaatgttcacaattaagct

SEQ ID NO: 32 - RNA, 21 nt, synthetic construct
  source 1..21: mol_type = other RNA; note = Description of Artificial Sequence: Synthetic oligonucleotide
aaaatgttcacaattaagctt

SEQ ID NO: 33 - RNA, 21 nt, synthetic construct
  source 1..21: mol_type = other RNA; note = Description of Artificial Sequence: Synthetic oligonucleotide
aaatgttcacaattaagctct

SEQ ID NO: 34 - RNA, 21 nt, synthetic construct
  source 1..21: mol_type = other RNA; note = Description of Artificial Sequence: Synthetic oligonucleotide
atgttcacaattaagctcctt

SEQ ID NO: 35 - RNA, 21 nt, synthetic construct
  source 1..21: mol_type = other RNA; note = Description of Artificial Sequence: Synthetic oligonucleotide
tgttcacaattaagctccttt

SEQ ID NO: 36 - RNA, 21 nt, synthetic construct
  source 1..21: mol_type = other RNA; note = Description of Artificial Sequence: Synthetic oligonucleotide
gttcacaattaagctccttct

SEQ ID NO: 37 - RNA, 21 nt, synthetic construct
  source 1..21: mol_type = other RNA; note = Description of Artificial Sequence: Synthetic oligonucleotide
ttcacaattaagctccttctt

SEQ ID NO: 38 - RNA, 21 nt, synthetic construct
  source 1..21: mol_type = other RNA; note = Description of Artificial Sequence: Synthetic oligonucleotide
tcacaattaagctccttcttt

SEQ ID NO: 39 - RNA, 21 nt, synthetic construct
  source 1..21: mol_type = other RNA; note = Description of Artificial Sequence: Synthetic oligonucleotide
cacaattaagctccttctttt

SEQ ID NO: 40 - RNA, 21 nt, synthetic construct
  source 1..21: mol_type = other RNA; note = Description of Artificial Sequence: Synthetic oligonucleotide
acaattaagctccttcttttt

SEQ ID NO: 41 - RNA, 21 nt, synthetic construct
  source 1..21: mol_type = other RNA; note = Description of Artificial Sequence: Synthetic oligonucleotide
caattaagctccttctttttt

SEQ ID NO: 42 - RNA, 21 nt, synthetic construct
  source 1..21: mol_type = other RNA; note = Description of Artificial Sequence: Synthetic oligonucleotide
aattaagctccttctttttat

SEQ ID NO: 43 - RNA, 21 nt, synthetic construct
  source 1..21: mol_type = other RNA; note = Description of Artificial Sequence: Synthetic oligonucleotide
attaagctccttctttttatt

SEQ ID NO: 44 - RNA, 21 nt, synthetic construct
  source 1..21: mol_type = other RNA; note = Description of Artificial Sequence: Synthetic oligonucleotide
ttaagctccttctttttattt

SEQ ID NO: 45 - RNA, 21 nt, synthetic construct
  source 1..21: mol_type = other RNA; note = Description of Artificial Sequence: Synthetic oligonucleotide
taagctccttctttttattgt

SEQ ID NO: 46 - RNA, 21 nt, synthetic construct
  source 1..21: mol_type = other RNA; note = Description of Artificial Sequence: Synthetic oligonucleotide
aagctccttctttttattgtt

SEQ ID NO: 47 - RNA, 21 nt, synthetic construct
  source 1..21: mol_type = other RNA; note = Description of Artificial Sequence: Synthetic oligonucleotide
agctccttctttttattgttt

SEQ ID NO: 48 - RNA, 21 nt, synthetic construct
  source 1..21: mol_type = other RNA; note = Description of Artificial Sequence: Synthetic oligonucleotide
gctccttctttttattgttct

SEQ ID NO: 49 - RNA, 21 nt, synthetic construct
  source 1..21: mol_type = other RNA; note = Description of Artificial Sequence: Synthetic oligonucleotide
ctccttctttttattgttcct

SEQ ID NO: 50 - RNA, 21 nt, synthetic construct
  source 1..21: mol_type = other RNA; note = Description of Artificial Sequence: Synthetic oligonucleotide
tccttctttttattgttcctt

SEQ ID NO: 51 - RNA, 21 nt, synthetic construct
  source 1..21: mol_type = other RNA; note = Description of Artificial Sequence: Synthetic oligonucleotide
ccttctttttattgttcctct

SEQ ID NO: 52 - RNA, 21 nt, synthetic construct
  source 1..21: mol_type = other RNA; note = Description of Artificial Sequence: Synthetic oligonucleotide
cttctttttattgttcctcta

SEQ ID NO: 53 - RNA, 21 nt, synthetic construct
  source 1..21: mol_type = other RNA; note = Description of Artificial Sequence: Synthetic oligonucleotide
tctttttattgttcctctagt

SEQ ID NO: 54 - RNA, 21 nt, synthetic construct
  source 1..21: mol_type = other RNA; note = Description of Artificial Sequence: Synthetic oligonucleotide
ctttttattgttcctctagtt

SEQ ID NO: 55 - RNA, 21 nt, synthetic construct
  source 1..21: mol_type = other RNA; note = Description of Artificial Sequence: Synthetic oligonucleotide
tttttattgttcctctagttt

SEQ ID NO: 56 - RNA, 21 nt, synthetic construct
  source 1..21: mol_type = other RNA; note = Description of Artificial Sequence: Synthetic oligonucleotide
ttttattgttcctctagttat

SEQ ID NO: 57 - RNA, 21 nt, synthetic construct
  source 1..21: mol_type = other RNA; note = Description of Artificial Sequence: Synthetic oligonucleotide
atttcaaaaactcaacatatt

SEQ ID NO: 58 - RNA, 21 nt, synthetic construct
  source 1..21: mol_type = other RNA; note = Description of Artificial Sequence: Synthetic oligonucleotide
tttcaaaaactcaacatattt

SEQ ID NO: 59 - RNA, 21 nt, synthetic construct
  source 1..21: mol_type = other RNA; note = Description of Artificial Sequence: Synthetic oligonucleotide
ttcaaaaactcaacatatttt

SEQ ID NO: 60 - RNA, 21 nt, synthetic construct
  source 1..21: mol_type = other RNA; note = Description of Artificial Sequence: Synthetic oligonucleotide
tcaaaaactcaacatatttgt

SEQ ID NO: 61 - RNA, 21 nt, synthetic construct
  source 1..21: mol_type = other RNA; note = Description of Artificial Sequence: Synthetic oligonucleotide
caaaaactcaacatatttgat

SEQ ID NO: 62 - RNA, 21 nt, synthetic construct
  source 1..21: mol_type = other RNA; note = Description of Artificial Sequence: Synthetic oligonucleotide
aaaaactcaacatatttgatt

SEQ ID NO: 63 - RNA, 21 nt, synthetic construct
  source 1..21: mol_type = other RNA; note = Description of Artificial Sequence: Synthetic oligonucleotide
aaaactcaacatatttgatct

SEQ ID NO: 64 - RNA, 21 nt, synthetic construct
  source 1..21: mol_type = other RNA; note = Description of Artificial Sequence: Synthetic oligonucleotide
aaactcaacatatttgatcat

SEQ ID NO: 65 - RNA, 21 nt, synthetic construct
  source 1..21: mol_type = other RNA; note = Description of Artificial Sequence: Synthetic oligonucleotide
aactcaacatatttgatcagt

SEQ ID NO: 66 - RNA, 21 nt, synthetic construct
  source 1..21: mol_type = other RNA; note = Description of Artificial Sequence: Synthetic oligonucleotide
actcaacatatttgatcagtt

SEQ ID NO: 67 - RNA, 21 nt, synthetic construct
  source 1..21: mol_type = other RNA; note = Description of Artificial Sequence: Synthetic oligonucleotide
tcaacatatttgatcagtctt

SEQ ID NO: 68 - RNA, 21 nt, synthetic construct
  source 1..21: mol_type = other RNA; note = Description of Artificial Sequence: Synthetic oligonucleotide
caacatatttgatcagtcttt

SEQ ID NO: 69 - RNA, 21 nt, synthetic construct
  source 1..21: mol_type = other RNA; note = Description of Artificial Sequence: Synthetic oligonucleotide
aacatatttgatcagtctttt

SEQ ID NO: 70 - RNA, 21 nt, synthetic construct
  source 1..21: mol_type = other RNA; note = Description of Artificial Sequence: Synthetic oligonucleotide
acatatttgatcagtcttttt

SEQ ID NO: 71 - RNA, 21 nt, synthetic construct
  source 1..21: mol_type = other RNA; note = Description of Artificial Sequence: Synthetic oligonucleotide
catatttgatcagtctttttt

SEQ ID NO: 72 - RNA, 21 nt, synthetic construct
  source 1..21: mol_type = other RNA; note = Description of Artificial Sequence: Synthetic oligonucleotide
atatttgatcagtctttttat

SEQ ID NO: 73 - RNA, 21 nt, synthetic construct
  source 1..21: mol_type = other RNA; note = Description of Artificial Sequence: Synthetic oligonucleotide
tatttgatcagtctttttatt

SEQ ID NO: 74 - RNA, 21 nt, synthetic construct
  source 1..21: mol_type = other RNA; note = Description of Artificial Sequence: Synthetic oligonucleotide
atttgatcagtctttttatgt

SEQ ID NO: 75 - RNA, 21 nt, synthetic construct
  source 1..21: mol_type = other RNA; note = Description of Artificial Sequence: Synthetic oligonucleotide
tttgatcagtctttttatgat

SEQ ID NO: 76 - RNA, 21 nt, synthetic construct
  source 1..21: mol_type = other RNA; note = Description of Artificial Sequence: Synthetic oligonucleotide
ttgatcagtctttttatgatt

SEQ ID NO: 77 - RNA, 21 nt, synthetic construct
  source 1..21: mol_type = other RNA; note = Description of Artificial Sequence: Synthetic oligonucleotide
tgatcagtctttttatgatct

SEQ ID NO: 78 - RNA, 21 nt, synthetic construct
  source 1..21: mol_type = other RNA; note = Description of Artificial Sequence: Synthetic oligonucleotide
gatcagtctttttatgatcta

SEQ ID NO: 79 - RNA, 21 nt, synthetic construct
  source 1..21: mol_type = other RNA; note = Description of Artificial Sequence: Synthetic oligonucleotide
atcagtctttttatgatctat

SEQ ID NO: 80 - RNA, 21 nt, synthetic construct
  source 1..21: mol_type = other RNA; note = Description of Artificial Sequence: Synthetic oligonucleotide
tcagtctttttatgatctatt

SEQ ID NO: 81 - RNA, 21 nt, synthetic construct
  source 1..21: mol_type = other RNA; note = Description of Artificial Sequence: Synthetic oligonucleotide
cagtctttttatgatctatct

SEQ ID NO: 82 - RNA, 21 nt, synthetic construct
  source 1..21: mol_type = other RNA; note = Description of Artificial Sequence: Synthetic oligonucleotide
agtctttttatgatctatcgt

SEQ ID NO: 83 - RNA, 21 nt, synthetic construct
  source 1..21: mol_type = other RNA; note = Description of Artificial Sequence: Synthetic oligonucleotide
gtctttttatgatctatcgct

SEQ ID NO: 84 - RNA, 21 nt, synthetic construct
  source 1..21: mol_type = other RNA; note = Description of Artificial Sequence: Synthetic oligonucleotide
tctttttatgatctatcgctt

SEQ ID NO: 85 - RNA, 21 nt, synthetic construct
  source 1..21: mol_type = other RNA; note = Description of Artificial Sequence: Synthetic oligonucleotide
ctttttatgatctatcgctgt

SEQ ID NO: 86 - RNA, 21 nt, synthetic construct
  source 1..21: mol_type = other RNA; note = Description of Artificial Sequence: Synthetic oligonucleotide
aactccagaacacccagaagt

SEQ ID NO: 87 - RNA, 21 nt, synthetic construct
  source 1..21: mol_type = other RNA; note = Description of Artificial Sequence: Synthetic oligonucleotide
actccagaacacccagaagta

SEQ ID NO: 88 - RNA, 21 nt, synthetic construct
  source 1..21: mol_type = other RNA; note = Description of Artificial Sequence: Synthetic oligonucleotide
ctccagaacacccagaagtaa

SEQ ID NO: 89 - RNA, 21 nt, synthetic construct
  source 1..21: mol_type = other RNA; note = Description of Artificial Sequence: Synthetic oligonucleotide
tccagaacacccagaagtaat

SEQ ID NO: 90 - RNA, 21 nt, synthetic construct
  source 1..21: mol_type = other RNA; note = Description of Artificial Sequence: Synthetic oligonucleotide
ccagaacacccagaagtaact

SEQ ID NO: 91 - RNA, 21 nt, synthetic construct
  source 1..21: mol_type = other RNA; note = Description of Artificial Sequence: Synthetic oligonucleotide
cagaacacccagaagtaactt

SEQ ID NO: 92 - RNA, 21 nt, synthetic construct
  source 1..21: mol_type = other RNA; note = Description of Artificial Sequence: Synthetic oligonucleotide
agaacacccagaagtaacttt

SEQ ID NO: 93 - RNA, 21 nt, synthetic construct
  source 1..21: mol_type = other RNA; note = Description of Artificial Sequence: Synthetic oligonucleotide
gaacacccagaagtaacttca

SEQ ID NO: 94 - RNA, 21 nt, synthetic construct
  source 1..21: mol_type = other RNA; note = Description of Artificial Sequence: Synthetic oligonucleotide
aacacccagaagtaacttcat

SEQ ID NO: 95 - RNA, 21 nt, synthetic construct
  source 1..21: mol_type = other RNA; note = Description of Artificial Sequence: Synthetic oligonucleotide
acacccagaagtaacttcact

SEQ ID NO: 96 - RNA, 21 nt, synthetic construct
  source 1..21: mol_type = other RNA; note = Description of Artificial Sequence: Synthetic oligonucleotide
cacccagaagtaacttcactt

SEQ ID NO: 97 - RNA, 21 nt, synthetic construct
  source 1..21: mol_type = other RNA; note = Description of Artificial Sequence: Synthetic oligonucleotide
acccagaagtaacttcacttt

SEQ ID NO: 98 - RNA, 21 nt, synthetic construct
  source 1..21: mol_type = other RNA; note = Description of Artificial Sequence: Synthetic oligonucleotide
cccagaagtaacttcacttaa

SEQ ID NO: 99 - RNA, 21 nt, synthetic construct
  source 1..21: mol_type = other RNA; note = Description of Artificial Sequence: Synthetic oligonucleotide
ccagaagtaacttcacttaaa

SEQ ID NO: 100 - RNA, 21 nt, synthetic construct
  source 1..21: mol_type = other RNA; note = Description of Artificial Sequence: Synthetic oligonucleotide
cagaagtaacttcacttaaaa

SEQ ID NO: 101 - RNA, 21 nt, synthetic construct
  source 1..21: mol_type = other RNA; note = Description of Artificial Sequence: Synthetic oligonucleotide
agaagtaacttcacttaaaat

SEQ ID NO: 102 - RNA, 21 nt, synthetic construct
  source 1..21: mol_type = other RNA; note = Description of Artificial Sequence: Synthetic oligonucleotide
gaagtaacttcacttaaaact

SEQ ID NO: 103 - RNA, 21 nt, synthetic construct
  source 1..21: mol_type = other RNA; note = Description of Artificial Sequence: Synthetic oligonucleotide
aagtaacttcacttaaaactt

SEQ ID NO: 104 - RNA, 21 nt, synthetic construct
  source 1..21: mol_type = other RNA; note = Description of Artificial Sequence: Synthetic oligonucleotide
agtaacttcacttaaaacttt

SEQ ID NO: 105 - RNA, 21 nt, synthetic construct
  source 1..21: mol_type = other RNA; note = Description of Artificial Sequence: Synthetic oligonucleotide
gtaacttcacttaaaactttt

SEQ ID NO: 106 - RNA, 21 nt, synthetic construct
  source 1..21: mol_type = other RNA; note = Description of Artificial Sequence: Synthetic oligonucleotide
taacttcacttaaaacttttt

SEQ ID NO: 107 - RNA, 21 nt, synthetic construct
  source 1..21: mol_type = other RNA; note = Description of Artificial Sequence: Synthetic oligonucleotide
aacttcacttaaaacttttgt

SEQ ID NO: 108 - RNA, 21 nt, synthetic construct
  source 1..21: mol_type = other RNA; note = Description of Artificial Sequence: Synthetic oligonucleotide
acttcacttaaaacttttgtt

SEQ ID NO: 109 - RNA, 21 nt, synthetic construct
  source 1..21: mol_type = other RNA; note = Description of Artificial Sequence: Synthetic oligonucleotide
cttcacttaaaacttttgtat

SEQ ID NO: 110 - RNA, 21 nt, synthetic construct
  source 1..21: mol_type = other RNA; note = Description of Artificial Sequence: Synthetic oligonucleotide
ttcacttaaaacttttgtagt

SEQ ID NO: 111 - RNA, 21 nt, synthetic construct
  source 1..21: mol_type = other RNA; note = Description of Artificial Sequence: Synthetic oligonucleotide
tcacttaaaacttttgtagat

SEQ ID NO: 112 - RNA, 21 nt, synthetic construct
  source 1..21: mol_type = other RNA; note = Description of Artificial Sequence: Synthetic oligonucleotide
cacttaaaacttttgtagaaa

SEQ ID NO: 113 - RNA, 21 nt, synthetic construct
  source 1..21: mol_type = other RNA; note = Description of Artificial Sequence: Synthetic oligonucleotide
acttaaaacttttgtagaaaa

SEQ ID NO: 114 - RNA, 21 nt, synthetic construct
  source 1..21: mol_type = other RNA; note = Description of Artificial Sequence: Synthetic oligonucleotide
aatgttcacaattaagctcct

SEQ ID NO: 115 - RNA, 21 nt, synthetic construct
  source 1..21: mol_type = other RNA; note = Description of Artificial Sequence: Synthetic oligonucleotide
atttgctatgttagacgatgt

SEQ ID NO: 116 - RNA, 21 nt, synthetic construct
  source 1..21: mol_type = other RNA; note = Description of Artificial Sequence: Synthetic oligonucleotide
ttgctatgttagacgatgtaa

SEQ ID NO: 117 - RNA, 21 nt, synthetic construct
  source 1..21: mol_type = other RNA; note = Description of Artificial Sequence: Synthetic oligonucleotide
tgctatgttagacgatgtaaa

SEQ ID NO: 118 - RNA, 21 nt, synthetic construct
  source 1..21: mol_type = other RNA; note = Description of Artificial Sequence: Synthetic oligonucleotide
aactgagaagaactacatata

SEQ ID NO: 119 - RNA, 21 nt, synthetic construct
  source 1..21: mol_type = other RNA; note = Description of Artificial Sequence: Synthetic oligonucleotide
aaccaacagcatagtcaaata

SEQ ID NO: 120 - RNA, 21 nt, synthetic construct
  source 1..21: mol_type = other RNA; note = Description of Artificial Sequence: Synthetic oligonucleotide
cccacagaaatttctctatct

SEQ ID NO: 121 - RNA, 21 nt, synthetic construct
  source 1..21: mol_type = other RNA; note = Description of Artificial Sequence: Synthetic oligonucleotide
caggtagtccatggacattaa

SEQ ID NO: 122 - RNA, 21 nt, synthetic construct
  source 1..21: mol_type = other RNA; note = Description of Artificial Sequence: Synthetic oligonucleotide
ggtagtccatggacattaatt

SEQ ID NO: 123 - RNA, 21 nt, synthetic construct
  source 1..21: mol_type = other RNA; note = Description of Artificial Sequence: Synthetic oligonucleotide
agttggaagactggaaagaca

SEQ ID NO: 124 - RNA, 21 nt, synthetic construct
  source 1..21: mol_type = other RNA; note = Description of Artificial Sequence: Synthetic oligonucleotide
tggaaagacaacaaacattat

SEQ ID NO: 125 - RNA, 21 nt, synthetic construct
  source 1..21: mol_type = other RNA; note = Description of Artificial Sequence: Synthetic oligonucleotide
tttacttgggaaatcacgaaa

SEQ ID NO: 126 - RNA, 21 nt, synthetic construct
  source 1..21: mol_type = other RNA; note = Description of Artificial Sequence: Synthetic oligonucleotide
gggaaatcacgaaaccaacta

SEQ ID NO: 127 - RNA, 21 nt, synthetic construct
  source 1..21: mol_type = other RNA; note = Description of Artificial Sequence: Synthetic oligonucleotide
gaaatcacgaaaccaactata

SEQ ID NO: 128 - RNA, 21 nt, synthetic construct
  source 1..21: mol_type = other RNA; note = Description of Artificial Sequence: Synthetic oligonucleotide
cgaaaccaactatacgctaca

SEQ ID NO: 129 - RNA, 21 nt, synthetic construct
  source 1..21: mol_type = other RNA; note = Description of Artificial Sequence: Synthetic oligonucleotide
atcaaccaaaatgttgatcca

SEQ ID NO: 130 - RNA, 21 nt, synthetic construct
  source 1..21: mol_type = other RNA; note = Description of Artificial Sequence: Synthetic oligonucleotide
ttaaaactctaaacttgacta

SEQ ID NO: 131 - RNA, 21 nt, synthetic construct
  source 1..21: mol_type = other RNA; note = Description of Artificial Sequence: Synthetic oligonucleotide
caaaacttgaaagcctcctat

SEQ ID NO: 132 - RNA, 21 nt, synthetic construct
  source 1..21: mol_type = other RNA; note = Description of Artificial Sequence: Synthetic oligonucleotide
tcaacatcgaatagatggatt

SEQ ID NO: 133 - RNA, 21 nt, synthetic construct
  source 1..21: mol_type = other RNA; note = Description of Artificial Sequence: Synthetic oligonucleotide
caaaacttcaatgaaacgtgt

SEQ ID NO: 134 - RNA, 21 nt, synthetic construct
  source 1..21: mol_type = other RNA; note = Description of Artificial Sequence: Synthetic oligonucleotide
aatcacgaaaccaactatact

SEQ ID NO: 135 - RNA, 21 nt, synthetic construct
  source 1..21: mol_type = other RNA; note = Description of Artificial Sequence: Synthetic oligonucleotide
gggaatcaattttagatggtt

SEQ ID NO: 136 - RNA, 21 nt, synthetic construct
  source 1..21: mol_type = other RNA; note = Description of Artificial Sequence: Synthetic oligonucleotide
caaaatgttgatccatccaat

SEQ ID NO: 137 - RNA, 21 nt, synthetic construct
  source 1..21: mol_type = other RNA; note = Description of Artificial Sequence: Synthetic oligonucleotide
tggacattaattcaacatcga

SEQ ID NO: 138 - RNA, 23 nt, synthetic construct
  source 1..23: mol_type = other RNA; note = Description of Artificial Sequence: Synthetic oligonucleotide
attaattgtgaacatttttatct

SEQ ID NO: 139 - RNA, 23 nt, synthetic construct
  source 1..23: mol_type = other RNA; note = Description of Artificial Sequence: Synthetic oligonucleotide
acttaattgtgaacatttttatc

SEQ ID NO: 140 - RNA, 23 nt, synthetic construct
  source 1..23: mol_type = other RNA; note = Description of Artificial Sequence: Synthetic oligonucleotide
agcttaattgtgaacatttttat

SEQ ID NO: 141 - RNA, 23 nt, synthetic construct
  source 1..23: mol_type = other RNA; note = Description of Artificial Sequence: Synthetic oligonucleotide
aagcttaattgtgaacattttta

SEQ ID NO: 142 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 7: mod_base = OTHER; note = Thymine
agagcttaattgtgaacattttt

SEQ ID NO: 143 - RNA, 23 nt, synthetic construct
  source 1..23: mol_type = other RNA; note = Description of Artificial Sequence: Synthetic oligonucleotide
aaggagcttaattgtgaacattt

SEQ ID NO: 144 - RNA, 23 nt, synthetic construct
  source 1..23: mol_type = other RNA; note = Description of Artificial Sequence: Synthetic oligonucleotide
aaaggagcttaattgtgaacatt

SEQ ID NO: 145 - RNA, 23 nt, synthetic construct
  source 1..23: mol_type = other RNA; note = Description of Artificial Sequence: Synthetic oligonucleotide
agaaggagcttaattgtgaacat

SEQ ID NO: 146 - RNA, 23 nt, synthetic construct
  source 1..23: mol_type = other RNA; note = Description of Artificial Sequence: Synthetic oligonucleotide
aagaaggagcttaattgtgaaca

SEQ ID NO: 147 - RNA, 23 nt, synthetic construct
  source 1..23: mol_type = other RNA; note = Description of Artificial Sequence: Synthetic oligonucleotide
aaagaaggagcttaattgtgaac

SEQ ID NO: 148 - RNA, 23 nt, synthetic construct
  source 1..23: mol_type = other RNA; note = Description of Artificial Sequence: Synthetic oligonucleotide
aaaagaaggagcttaattgtgaa

SEQ ID NO: 149 - RNA, 23 nt, synthetic construct
  source 1..23: mol_type = other RNA; note = Description of Artificial Sequence: Synthetic oligonucleotide
aaaaagaaggagcttaattgtga

SEQ ID NO: 150 - RNA, 23 nt, synthetic construct
  source 1..23: mol_type = other RNA; note = Description of Artificial Sequence: Synthetic oligonucleotide
aaaaaagaaggagcttaattgtg

SEQ ID NO: 151 - RNA, 23 nt, synthetic construct
  source 1..23: mol_type = other RNA; note = Description of Artificial Sequence: Synthetic oligonucleotide
ataaaaagaaggagcttaattgt

SEQ ID NO: 152 - RNA, 23 nt, synthetic construct
  source 1..23: mol_type = other RNA; note = Description of Artificial Sequence: Synthetic oligonucleotide
aataaaaagaaggagcttaattg

SEQ ID NO: 153 - RNA, 23 nt, synthetic construct
  source 1..23: mol_type = other RNA; note = Description of Artificial Sequence: Synthetic oligonucleotide
aaataaaaagaaggagcttaatt

SEQ ID NO: 154 - RNA, 23 nt, synthetic construct
  source 1..23: mol_type = other RNA; note = Description of Artificial Sequence: Synthetic oligonucleotide
acaataaaaagaaggagcttaat

SEQ ID NO: 155 - RNA, 23 nt, synthetic construct
  source 1..23: mol_type = other RNA; note = Description of Artificial Sequence: Synthetic oligonucleotide
aacaataaaaagaaggagcttaa

SEQ ID NO: 156 - RNA, 23 nt, synthetic construct
  source 1..23: mol_type = other RNA; note = Description of Artificial Sequence: Synthetic oligonucleotide
aaacaataaaaagaaggagctta

SEQ ID NO: 157 - RNA, 23 nt, synthetic construct
  source 1..23: mol_type = other RNA; note = Description of Artificial Sequence: Synthetic oligonucleotide
agaacaataaaaagaaggagctt

SEQ ID NO: 158 - RNA, 23 nt, synthetic construct
  source 1..23: mol_type = other RNA; note = Description of Artificial Sequence: Synthetic oligonucleotide
aggaacaataaaaagaaggagct

SEQ ID NO: 159 - RNA, 23 nt, synthetic construct
  source 1..23: mol_type = other RNA; note = Description of Artificial Sequence: Synthetic oligonucleotide
aaggaacaataaaaagaaggagc

SEQ ID NO: 160 - RNA, 23 nt, synthetic construct
  source 1..23: mol_type = other RNA; note = Description of Artificial Sequence: Synthetic oligonucleotide
agaggaacaataaaaagaaggag

SEQ ID NO: 161 - RNA, 23 nt, synthetic construct
  source 1..23: mol_type = other RNA; note = Description of Artificial Sequence: Synthetic oligonucleotide
tagaggaacaataaaaagaagga

SEQ ID NO: 162 - RNA, 23 nt, synthetic construct
  source 1..23: mol_type = other RNA; note = Description of Artificial Sequence: Synthetic oligonucleotide
actagaggaacaataaaaagaag

SEQ ID NO: 163 - RNA, 23 nt, synthetic construct
  source 1..23: mol_type = other RNA; note = Description of Artificial Sequence: Synthetic oligonucleotide
aactagaggaacaataaaaagaa

SEQ ID NO: 164 - RNA, 23 nt, synthetic construct
  source 1..23: mol_type = other RNA; note = Description of Artificial Sequence: Synthetic oligonucleotide
aaactagaggaacaataaaaaga

SEQ ID NO: 165 - RNA, 23 nt, synthetic construct
  source 1..23: mol_type = other RNA; note = Description of Artificial Sequence: Synthetic oligonucleotide
ataactagaggaacaataaaaag

SEQ ID NO: 166 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 5: mod_base = OTHER; note = Thymine
  modified_base 7: mod_base = OTHER; note = Thymine
aatatgttgagtttttgaaatat

SEQ ID NO: 167 - RNA, 23 nt, synthetic construct
  source 1..23: mol_type = other RNA; note = Description of Artificial Sequence: Synthetic oligonucleotide
aaatatgttgagtttttgaaata

SEQ ID NO: 168 - RNA, 23 nt, synthetic construct
  source 1..23: mol_type = other RNA; note = Description of Artificial Sequence: Synthetic oligonucleotide
aaaatatgttgagtttttgaaat

SEQ ID NO: 169 - RNA, 23 nt, synthetic construct
  source 1..23: mol_type = other RNA; note = Description of Artificial Sequence: Synthetic oligonucleotide
acaaatatgttgagtttttgaaa

SEQ ID NO: 170 - RNA, 23 nt, synthetic construct
  source 1..23: mol_type = other RNA; note = Description of Artificial Sequence: Synthetic oligonucleotide
atcaaatatgttgagtttttgaa

SEQ ID NO: 171 - RNA, 23 nt, synthetic construct
  source 1..23: mol_type = other RNA; note = Description of Artificial Sequence: Synthetic oligonucleotide
aatcaaatatgttgagtttttga

SEQ ID NO: 172 - RNA, 23 nt, synthetic construct
  source 1..23: mol_type = other RNA; note = Description of Artificial Sequence: Synthetic oligonucleotide
agatcaaatatgttgagtttttg

SEQ ID NO: 173 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 5: mod_base = OTHER; note = Thymine
atgatcaaatatgttgagttttt

SEQ ID NO: 174 - RNA, 23 nt, synthetic construct
  source 1..23: mol_type = other RNA; note = Description of Artificial Sequence: Synthetic oligonucleotide
actgatcaaatatgttgagtttt

SEQ ID NO: 175 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 7: mod_base = OTHER; note = Thymine
aactgatcaaatatgttgagttt

SEQ ID NO: 176 - RNA, 23 nt, synthetic construct
  source 1..23: mol_type = other RNA; note = Description of Artificial Sequence: Synthetic oligonucleotide
aagactgatcaaatatgttgagt

SEQ ID NO: 177 - RNA, 23 nt, synthetic construct
  source 1..23: mol_type = other RNA; note = Description of Artificial Sequence: Synthetic oligonucleotide
aaagactgatcaaatatgttgag

SEQ ID NO: 178 - RNA, 23 nt, synthetic construct
  source 1..23: mol_type = other RNA; note = Description of Artificial Sequence: Synthetic oligonucleotide
aaaagactgatcaaatatgttga

SEQ ID NO: 179 - RNA, 23 nt, synthetic construct
  source 1..23: mol_type = other RNA; note = Description of Artificial Sequence: Synthetic oligonucleotide
aaaaagactgatcaaatatgttg

SEQ ID NO: 180 - RNA, 23 nt, synthetic construct
  source 1..23: mol_type = other RNA; note = Description of Artificial Sequence: Synthetic oligonucleotide
aaaaaagactgatcaaatatgtt

SEQ ID NO: 181 - RNA, 23 nt, synthetic construct
  source 1..23: mol_type = other RNA; note = Description of Artificial Sequence: Synthetic oligonucleotide
ataaaaagactgatcaaatatgt

SEQ ID NO: 182 - RNA, 23 nt, synthetic construct
  source 1..23: mol_type = other RNA; note = Description of Artificial Sequence: Synthetic oligonucleotide
aataaaaagactgatcaaatatg

SEQ ID NO: 183 - RNA, 23 nt, synthetic construct
  source 1..23: mol_type = other RNA; note = Description of Artificial Sequence: Synthetic oligonucleotide
acataaaaagactgatcaaatat

SEQ ID NO: 184 - RNA, 23 nt, synthetic construct
  source 1..23: mol_type = other RNA; note = Description of Artificial Sequence: Synthetic oligonucleotide
atcataaaaagactgatcaaata

SEQ ID NO: 185 - RNA, 23 nt, synthetic construct
  source 1..23: mol_type = other RNA; note = Description of Artificial Sequence: Synthetic oligonucleotide
aatcataaaaagactgatcaaat

SEQ ID NO: 186 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 7: mod_base = OTHER; note = Thymine
agatcataaaaagactgatcaaa

SEQ ID NO: 187 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 5: mod_base = OTHER; note = Thymine
tagatcataaaaagactgatcaa

SEQ ID NO: 188 - RNA, 23 nt, synthetic construct
  source 1..23: mol_type = other RNA; note = Description of Artificial Sequence: Synthetic oligonucleotide
atagatcataaaaagactgatca

SEQ ID NO: 189 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 7: mod_base = OTHER; note = Thymine
aatagatcataaaaagactgatc

SEQ ID NO: 190 - RNA, 23 nt, synthetic construct
  source 1..23: mol_type = other RNA; note = Description of Artificial Sequence: Synthetic oligonucleotide
agatagatcataaaaagactgat

SEQ ID NO: 191 - RNA, 23 nt, synthetic construct
  source 1..23: mol_type = other RNA; note = Description of Artificial Sequence: Synthetic oligonucleotide
acgatagatcataaaaagactga

SEQ ID NO: 192 - RNA, 23 nt, synthetic construct
  source 1..23: mol_type = other RNA; note = Description of Artificial Sequence: Synthetic oligonucleotide
agcgatagatcataaaaagactg

SEQ ID NO: 193 - RNA, 23 nt, synthetic construct
  source 1..23: mol_type = other RNA; note = Description of Artificial Sequence: Synthetic oligonucleotide
aagcgatagatcataaaaagact

SEQ ID NO: 194 - RNA, 23 nt, synthetic construct
  source 1..23: mol_type = other RNA; note = Description of Artificial Sequence: Synthetic oligonucleotide
acagcgatagatcataaaaagac

SEQ ID NO: 195 - RNA, 23 nt, synthetic construct
  source 1..23: mol_type = other RNA; note = Description of Artificial Sequence: Synthetic oligonucleotide
acttctgggtgttctggagtttc

SEQ ID NO: 196 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 5: mod_base = OTHER; note = Thymine
  modified_base 7: mod_base = OTHER; note = Thymine
tacttctgggtgttctggagttt

SEQ ID NO: 197 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 5: mod_base = OTHER; note = Thymine
ttacttctgggtgttctggagtt

SEQ ID NO: 198 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 7: mod_base = OTHER; note = Thymine
attacttctgggtgttctggagt

SEQ ID NO: 199 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 7: mod_base = OTHER; note = Thymine
agttacttctgggtgttctggag

SEQ ID NO: 200 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 5: mod_base = OTHER; note = Thymine
aagttacttctgggtgttctgga

SEQ ID NO: 201 - RNA, 23 nt, synthetic construct
  source 1..23: mol_type = other RNA; note = Description of Artificial Sequence: Synthetic oligonucleotide
aaagttacttctgggtgttctgg

SEQ ID NO: 202 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 7: mod_base = OTHER; note = Thymine
tgaagttacttctgggtgttctg

SEQ ID NO: 203 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 7: mod_base = OTHER; note = Thymine
atgaagttacttctgggtgttct

SEQ ID NO: 204 - RNA, 23 nt, synthetic construct
  source 1..23: mol_type = other RNA; note = Description of Artificial Sequence: Synthetic oligonucleotide
agtgaagttacttctgggtgttc

SEQ ID NO: 205 - RNA, 23 nt, synthetic construct
  source 1..23: mol_type = other RNA; note = Description of Artificial Sequence: Synthetic oligonucleotide
aagtgaagttacttctgggtgtt

SEQ ID NO: 206 - RNA, 23 nt, synthetic construct
  source 1..23: mol_type = other RNA; note = Description of Artificial Sequence: Synthetic oligonucleotide
aaagtgaagttacttctgggtgt

SEQ ID NO: 207 - RNA, 23 nt, synthetic construct
  source 1..23: mol_type = other RNA; note = Description of Artificial Sequence: Synthetic oligonucleotide
ttaagtgaagttacttctgggtg

SEQ ID NO: 208 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 7: mod_base = OTHER; note = Thymine
tttaagtgaagttacttctgggt

SEQ ID NO: 209 - RNA, 23 nt, synthetic construct
  source 1..23: mol_type = other RNA; note = Description of Artificial Sequence: Synthetic oligonucleotide
ttttaagtgaagttacttctggg

SEQ ID NO: 210 - RNA, 23 nt, synthetic construct
  source 1..23: mol_type = other RNA; note = Description of Artificial Sequence: Synthetic oligonucleotide
attttaagtgaagttacttctgg

SEQ ID NO: 211 - RNA, 23 nt, synthetic construct
  source 1..23: mol_type = other RNA; note = Description of Artificial Sequence: Synthetic oligonucleotide
agttttaagtgaagttacttctg

SEQ ID NO: 212 - RNA, 23 nt, synthetic construct
  source 1..23: mol_type = other RNA; note = Description of Artificial Sequence: Synthetic oligonucleotide
aagttttaagtgaagttacttct

SEQ ID NO: 213 - RNA, 23 nt, synthetic construct
  source 1..23: mol_type = other RNA; note = Description of Artificial Sequence: Synthetic oligonucleotide
aaagttttaagtgaagttacttc

SEQ ID NO: 214 - RNA, 23 nt, synthetic construct
  source 1..23: mol_type = other RNA; note = Description of Artificial Sequence: Synthetic oligonucleotide
aaaagttttaagtgaagttactt

SEQ ID NO: 215 - RNA, 23 nt, synthetic construct
  source 1..23: mol_type = other RNA; note = Description of Artificial Sequence: Synthetic oligonucleotide
aaaaagttttaagtgaagttact

SEQ ID NO: 216 - RNA, 23 nt, synthetic construct
  source 1..23: mol_type = other RNA; note = Description of Artificial Sequence: Synthetic oligonucleotide
acaaaagttttaagtgaagttac

SEQ ID NO: 217 - RNA, 23 nt, synthetic construct
  source 1..23: mol_type = other RNA; note = Description of Artificial Sequence: Synthetic oligonucleotide
aacaaaagttttaagtgaagtta

SEQ ID NO: 218 - RNA, 23 nt, synthetic construct
  source 1..23: mol_type = other RNA; note = Description of Artificial Sequence: Synthetic oligonucleotide
atacaaaagttttaagtgaagtt

SEQ ID NO: 219 - RNA, 23 nt, synthetic construct
  source 1..23: mol_type = other RNA; note = Description of Artificial Sequence: Synthetic oligonucleotide
actacaaaagttttaagtgaagt

SEQ ID NO: 220 - RNA, 23 nt, synthetic construct
  source 1..23: mol_type = other RNA; note = Description of Artificial Sequence: Synthetic oligonucleotide
atctacaaaagttttaagtgaag

SEQ ID NO: 221 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 5: mod_base = OTHER; note = Thymine
tttctacaaaagttttaagtgaa

SEQ ID NO: 222 - RNA, 23 nt, synthetic construct
  source 1..23: mol_type = other RNA; note = Description of Artificial Sequence: Synthetic oligonucleotide
ttttctacaaaagttttaagtga

SEQ ID NO: 223 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 7: mod_base = OTHER; note = Thymine
  modified_base 12: mod_base = OTHER; note = Thymine
aggagcttaattgtgaacatttt

SEQ ID NO: 224 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 7: mod_base = OTHER; note = Thymine
acatcgtctaacatagcaaatct

SEQ ID NO: 225 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 2: mod_base = OTHER; note = Thymine
ttacatcgtctaacatagcaaat

SEQ ID NO: 226 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 2: mod_base = OTHER; note = Thymine
  modified_base 7: mod_base = OTHER; note = Thymine
  modified_base 12: mod_base = OTHER; note = Thymine
tttacatcgtctaacatagcaaa

SEQ ID NO: 227 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 5: mod_base = OTHER; note = Thymine
  modified_base 7: mod_base = OTHER; note = Thymine
tatatgtagttcttctcagttcc

SEQ ID NO: 228 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 5: mod_base = OTHER; note = Thymine
tatttgactatgctgttggttta

SEQ ID NO: 229 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 12: mod_base = OTHER; note = Thymine
agatagagaaatttctgtgggtt

SEQ ID NO: 230 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 2: mod_base = OTHER; note = Thymine
  modified_base 5: mod_base = OTHER; note = Thymine
  modified_base 7: mod_base = OTHER; note = Thymine
ttaatgtccatggactacctgat

SEQ ID NO: 231 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 7: mod_base = OTHER; note = Thymine
aattaatgtccatggactacctg

SEQ ID NO: 232 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 5: mod_base = OTHER; note = Thymine
  modified_base 7: mod_base = OTHER; note = Thymine
  modified_base 12: mod_base = OTHER; note = Thymine
tgtctttccagtcttccaactca

SEQ ID NO: 233 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 2: mod_base = OTHER; note = Thymine
  modified_base 5: mod_base = OTHER; note = Thymine
  modified_base 7: mod_base = OTHER; note = Thymine
  modified_base 12: mod_base = OTHER; note = Thymine
ataatgtttgttgtctttccagt

SEQ ID NO: 234 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 2: mod_base = OTHER; note = Thymine
tttcgtgatttcccaagtaaaaa

SEQ ID NO: 235 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 5: mod_base = OTHER; note = Thymine
tagttggtttcgtgatttcccaa

SEQ ID NO: 236 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 7: mod_base = OTHER; note = Thymine
  modified_base 12: mod_base = OTHER; note = Thymine
tatagttggtttcgtgatttccc

SEQ ID NO: 237 - RNA, 23 nt, synthetic construct
  source 1..23: mol_type = other RNA; note = Description of Artificial Sequence: Synthetic oligonucleotide
tgtagcgtatagttggtttcgtg

SEQ ID NO: 238 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 5: mod_base = OTHER; note = Thymine
  modified_base 12: mod_base = OTHER; note = Thymine
tggatcaacattttggttgattt

SEQ ID NO: 239 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 12: mod_base = OTHER; note = Thymine
tagtcaagttttgagttttaaca

SEQ ID NO: 240 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 2: mod_base = OTHER; note = Thymine
  modified_base 12: mod_base = OTHER; note = Thymine
ataggaggctttcaagttttgag

SEQ ID NO: 241 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 7: mod_base = OTHER; note = Thymine
  modified_base 12: mod_base = OTHER; note = Thymine
aatccatctattcgatgttgaat

SEQ ID NO: 242 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 7: mod_base = OTHER; note = Thymine
  modified_base 12: mod_base = OTHER; note = Thymine
acacgtttcattgaagttttgtg

SEQ ID NO: 243 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 5: mod_base = OTHER; note = Thymine
  modified_base 12: mod_base = OTHER; note = Thymine
agtatagttggtttcgtgatttc

SEQ ID NO: 244 - RNA, 23 nt, synthetic construct
  source 1..23: mol_type = other RNA; note = Description of Artificial Sequence: Synthetic oligonucleotide
aaccatctaaaattgattcccac

SEQ ID NO: 245 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 2: mod_base = OTHER; note = Thymine
  modified_base 7: mod_base = OTHER; note = Thymine
attggatggatcaacattttggt

SEQ ID NO: 246 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 5: mod_base = OTHER; note = Thymine
  modified_base 7: mod_base = OTHER; note = Thymine
  modified_base 12: mod_base = OTHER; note = Thymine
tcgatgttgaattaatgtccatg

SEQ ID NO: 247 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 7: mod_base = OTHER; note = Thymine
  modified_base 12: mod_base = OTHER; note = Thymine
  modified_base 14: mod_base = OTHER; note = Thymine
aggagcttaattgtgaacatttt

SEQ ID NO: 248 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 7: mod_base = OTHER; note = Thymine
  modified_base 14: mod_base = OTHER; note = Thymine
acatcgtctaacatagcaaatct

SEQ ID NO: 249 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 2: mod_base = OTHER; note = Thymine
  modified_base 16: mod_base = OTHER; note = Thymine
ttacatcgtctaacatagcaaat

SEQ ID NO: 250 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 5: mod_base = OTHER; note = Thymine
  modified_base 7: mod_base = OTHER; note = Thymine
  modified_base 14: mod_base = OTHER; note = Thymine
  modified_base 16: mod_base = OTHER; note = Thymine
tatatgtagttcttctcagttcc

SEQ ID NO: 251 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 5: mod_base = OTHER; note = Thymine
  modified_base 14: mod_base = OTHER; note = Thymine
  modified_base 16: mod_base = OTHER; note = Thymine
tatttgactatgctgttggttta

SEQ ID NO: 252 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 12: mod_base = OTHER; note = Thymine
  modified_base 14: mod_base = OTHER; note = Thymine
  modified_base 16: mod_base = OTHER; note = Thymine
agatagagaaatttctgtgggtt

SEQ ID NO: 253 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 2: mod_base = OTHER; note = Thymine
  modified_base 5: mod_base = OTHER; note = Thymine
  modified_base 7: mod_base = OTHER; note = Thymine
  modified_base 16: mod_base = OTHER; note = Thymine
ttaatgtccatggactacctgat

SEQ ID NO: 254 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 5: mod_base = OTHER; note = Thymine
  modified_base 7: mod_base = OTHER; note = Thymine
  modified_base 12: mod_base = OTHER; note = Thymine
  modified_base 14: mod_base = OTHER; note = Thymine
tgtctttccagtcttccaactca

SEQ ID NO: 255 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 2: mod_base = OTHER; note = Thymine
  modified_base 5: mod_base = OTHER; note = Thymine
  modified_base 7: mod_base = OTHER; note = Thymine
  modified_base 12: mod_base = OTHER; note = Thymine
  modified_base 14: mod_base = OTHER; note = Thymine
  modified_base 16: mod_base = OTHER; note = Thymine
ataatgtttgttgtctttccagt

SEQ ID NO: 256 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 5: mod_base = OTHER; note = Thymine
  modified_base 16: mod_base = OTHER; note = Thymine
tagttggtttcgtgatttcccaa

SEQ ID NO: 257 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 14: mod_base = OTHER; note = Thymine
tgtagcgtatagttggtttcgtg

SEQ ID NO: 258 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 5: mod_base = OTHER; note = Thymine
  modified_base 12: mod_base = OTHER; note = Thymine
  modified_base 14: mod_base = OTHER; note = Thymine
tggatcaacattttggttgattt

SEQ ID NO: 259 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 12: mod_base = OTHER; note = Thymine
  modified_base 16: mod_base = OTHER; note = Thymine
tagtcaagttttgagttttaaca

SEQ ID NO: 260 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 7: mod_base = OTHER; note = Thymine
  modified_base 12: mod_base = OTHER; note = Thymine
  modified_base 16: mod_base = OTHER; note = Thymine
aatccatctattcgatgttgaat

SEQ ID NO: 261 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 5: mod_base = OTHER; note = Thymine
  modified_base 12: mod_base = OTHER; note = Thymine
  modified_base 14: mod_base = OTHER; note = Thymine
agtatagttggtttcgtgatttc

SEQ ID NO: 262 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 14: mod_base = OTHER; note = Thymine
aaccatctaaaattgattcccac

SEQ ID NO: 263 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 5: mod_base = OTHER; note = Thymine
  modified_base 7: mod_base = OTHER; note = Thymine
  modified_base 12: mod_base = OTHER; note = Thymine
  modified_base 16: mod_base = OTHER; note = Thymine
tcgatgttgaattaatgtccatg

SEQ ID NO: 264 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methyluridine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-fluoroadenosine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note 2'-O-methyluridine-3'-phosphate-N-[tris(GalNAc-alkyl)-amido decanoyl)]-4-hydroxyprolinol (Hyp-(GalNAc-alkyl)3)
ataaaaatgttcacaattaat

SEQ ID NO: 265 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methyladenosine-3'- phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-fluorouridine-3'-phosphate
  modified_base 8: mod_base = OTHER; note = 2'-O-methylguanosine-3'-phosphate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluorocytidine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note 2'-O-methyluridine-3'-phosphate-N-[tris(GalNAc-alkyl)-amido decanoyl)]-4-hydroxyprolinol (Hyp-(GalNAc-alkyl)3)
taaaaatgttcacaattaagt

SEQ ID NO: 266 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-fluoroguanosine-3'-phosphate
  modified_base 8: mod_base = OTHER; note = 2'-O-methyluridine-3'-phosphate
  modified_base 9: mod_base = OTHER; note = 2'-fluorouridine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note 2'-O-methyluridine-3'-phosphate-N-[tris(GalNAc-alkyl)-amido decanoyl)]-4-hydroxyprolinol (Hyp-(GalNAc-alkyl)3)
aaaaatgttcacaattaagct

SEQ ID NO: 267 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-fluorouridine-3'-phosphate
  modified_base 8: mod_base = OTHER; note = 2'-O-methyluridine-3'-phosphate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluorocytidine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note 2'-O-methyluridine-3'-phosphate-N-[tris(GalNAc-alkyl)-amido decanoyl)]-4-hydroxyprolinol (Hyp-(GalNAc-alkyl)3)
aaaatgttcacaattaagctt

SEQ ID NO: 268 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-fluorouridine-3'-phosphate
  modified_base 8: mod_base = OTHER; note = 2'-O-methylcytidine-3'-phosphate
  modified_base 9: mod_base = OTHER; note = 2'-fluoroadenosine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note 2'-O-methyluridine-3'-phosphate-N-[tris(GalNAc-alkyl)-amido decanoyl)]-4-hydroxyprolinol (Hyp-(GalNAc-alkyl)3)
aaatgttcacaattaagctct

SEQ ID NO: 269 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-fluoroadenosine-3'-phosphate
  modified_base 8: mod_base = OTHER; note = 2'-O-methylcytidine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluorouridine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note 2'-O-methyluridine-3'-phosphate-N-[tris(GalNAc-alkyl)-amido decanoyl)]-4-hydroxyprolinol (Hyp-(GalNAc-alkyl)3)
atgttcacaattaagctcctt

SEQ ID NO: 270 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methylguanosine-3'- phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-fluorocytidine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note 2'-O-methyluridine-3'-phosphate-N-[tris(GalNAc-alkyl)-amido decanoyl)]-4-hydroxyprolinol (Hyp-(GalNAc-alkyl)3)
tgttcacaattaagctccttt

SEQ ID NO: 271 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'- phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-fluoroadenosine-3'-phosphate
  modified_base 8: mod_base = OTHER; note = 2'-O-methyladenosine-3'-phosphate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluoroadenosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note 2'-O-methyluridine-3'-phosphate-N-[tris(GalNAc-alkyl)-amido decanoyl)]-4-hydroxyprolinol (Hyp-(GalNAc-alkyl)3)
gttcacaattaagctccttct

SEQ ID NO: 272 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-fluoroadenosine-3'-phosphate
  modified_base 8: mod_base = OTHER; note = 2'-O-methyluridine-3'-phosphate
  modified_base 9: mod_base = OTHER; note = 2'-fluorouridine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note 2'-O-methyluridine-3'-phosphate-N-[tris(GalNAc-alkyl)-amido decanoyl)]-4-hydroxyprolinol (Hyp-(GalNAc-alkyl)3)
ttcacaattaagctccttctt

SEQ ID NO: 273 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methylcytidine-3'- phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-fluorouridine-3'-phosphate
  modified_base 8: mod_base = OTHER; note = 2'-O-methyluridine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note 2'-O-methyluridine-3'-phosphate-N-[tris(GalNAc-alkyl)-amido decanoyl)]-4-hydroxyprolinol (Hyp-(GalNAc-alkyl)3)
tcacaattaagctccttcttt

SEQ ID NO: 274 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-fluorouridine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluorocytidine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note 2'-O-methyluridine-3'-phosphate-N-[tris(GalNAc-alkyl)-amido decanoyl)]-4-hydroxyprolinol (Hyp-(GalNAc-alkyl)3)
cacaattaagctccttctttt

SEQ ID NO: 275 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methylcytidine-3'- phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-fluoroadenosine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note 2'-O-methyluridine-3'-phosphate-N-[tris(GalNAc-alkyl)-amido decanoyl)]-4-hydroxyprolinol (Hyp-(GalNAc-alkyl)3)
acaattaagctccttcttttt

SEQ ID NO: 276 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = 2'-fluoroadenosine-3'-phosphate
  modified_base 8: mod_base = OTHER; note = 2'-O-methylguanosine-3'-phosphate
  modified_base 9: mod_base = OTHER; note = 2'-fluorocytidine-3'-phosphate
  modified_base 10: mod_base = OTHER; note = 2'-fluorouridine-3'-phosphate
  modified_base 11: mod_base = OTHER; note = 2'-fluorocytidine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note 2'-O-methyluridine-3'-phosphate-N-[tris(GalNAc-alkyl)-amido decanoyl)]-4-hydroxyprolinol (Hyp-(GalNAc-alkyl)3)
caattaagctccttctttttt

SEQ ID NO: 277 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-fluoroguanosine-3'-phosphate
  modified_base 8: mod_base = OTHER; note = 2'-O-methylcytidine-3'-phosphate
  modified_base 9: mod_base = OTHER; note = 2'-fluorouridine-3'-phosphate
  modified_base 10: mod_base = OTHER; note = 2'-fluorocytidine-3'-phosphate
  modified_base 11: mod_base = OTHER; note = 2'-fluorocytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note 2'-O-methyluridine-3'-phosphate-N-[tris(GalNAc-alkyl)-amido decanoyl)]-4-hydroxyprolinol (Hyp-(GalNAc-alkyl)3)
aattaagctccttctttttat

SEQ ID NO: 278 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-fluorocytidine-3'-phosphate
  modified_base 8: mod_base = OTHER; note = 2'-O-methyluridine-3'-phosphate
  modified_base 9: mod_base = OTHER; note = 2'-fluorocytidine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note 2'-O-methyluridine-3'-phosphate-N-[tris(GalNAc-alkyl)-amido decanoyl)]-4-hydroxyprolinol (Hyp-(GalNAc-alkyl)3)
attaagctccttctttttatt

SEQ ID NO: 279 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = 2'-fluorouridine-3'-phosphate
  modified_base 8: mod_base = OTHER; note = 2'-O-methylcytidine-3'-phosphate
  modified_base 9: mod_base = OTHER; note = 2'-fluorocytidine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note 2'-O-methyluridine-3'-phosphate-N-[tris(GalNAc-alkyl)-amido decanoyl)]-4-hydroxyprolinol (Hyp-(GalNAc-alkyl)3)
ttaagctccttctttttattt

SEQ ID NO: 280 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methyladenosine-3'- phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-fluorocytidine-3'-phosphate
  modified_base 8: mod_base = OTHER; note = 2'-O-methylcytidine-3'-phosphate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluorocytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note 2'-O-methyluridine-3'-phosphate-N-[tris(GalNAc-alkyl)-amido decanoyl)]-4-hydroxyprolinol (Hyp-(GalNAc-alkyl)3)
taagctccttctttttattgt

SEQ ID NO: 281 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methylguanosine-3'- phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = 2'-fluorouridine-3'-phosphate
  modified_base 8: mod_base = OTHER; note = 2'-O-methyluridine-3'-phosphate
  modified_base 9: mod_base = OTHER; note = 2'-fluorocytidine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note 2'-O-methyluridine-3'-phosphate-N-[tris(GalNAc-alkyl)-amido decanoyl)]-4-hydroxyprolinol (Hyp-(GalNAc-alkyl)3)
agctccttctttttattgttt

SEQ ID NO: 282 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'- phosphorothioate
  modified_base 2: mod_base = OTHER; note = 2'-O-methylcytidine-3'- phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-fluorouridine-3'-phosphate
  modified_base 8: mod_base = OTHER; note = 2'-O-methylcytidine-3'-phosphate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note 2'-O-methyluridine-3'-phosphate-N-[tris(GalNAc-alkyl)-amido decanoyl)]-4-hydroxyprolinol (Hyp-(GalNAc-alkyl)3)
gctccttctttttattgttct

SEQ ID NO: 283 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'- phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-fluorocytidine-3'-phosphate
  modified_base 8: mod_base = OTHER; note = 2'-O-methyluridine-3'-phosphate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note 2'-O-methyluridine-3'-phosphate-N-[tris(GalNAc-alkyl)-amido decanoyl)]-4-hydroxyprolinol (Hyp-(GalNAc-alkyl)3)
ctccttctttttattgttcct

SEQ ID NO: 284 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methylcytidine-3'- phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-fluorouridine-3'-phosphate
  modified_base 8: mod_base = OTHER; note = 2'-O-methyluridine-3'-phosphate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note 2'-O-methyluridine-3'-phosphate-N-[tris(GalNAc-alkyl)-amido decanoyl)]-4-hydroxyprolinol (Hyp-(GalNAc-alkyl)3)
tccttctttttattgttcctt

SEQ ID NO: 285 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'- phosphorothioate
  modified_base 2: mod_base = OTHER; note = 2'-O-methylcytidine-3'- phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-fluorouridine-3'-phosphate
  modified_base 8: mod_base = OTHER; note = 2'-O-methyluridine-3'-phosphate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluoroadenosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note 2'-O-methyluridine-3'-phosphate-N-[tris(GalNAc-alkyl)-amido decanoyl)]-4-hydroxyprolinol (Hyp-(GalNAc-alkyl)3)
ccttctttttattgttcctct

SEQ ID NO: 286 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'- phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-fluorouridine-3'-phosphate
  modified_base 8: mod_base = OTHER; note = 2'-O-methyluridine-3'-phosphate
  modified_base 9: mod_base = OTHER; note = 2'-fluorouridine-3'-phosphate
  modified_base 10: mod_base = OTHER; note = 2'-fluoroadenosine-3'-phosphate
  modified_base 11: mod_base = OTHER; note = 2'-fluorouridine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note 2'-O-methyladenosine-3'-phosphate-N-[tris(GalNAc-alkyl)-ami dodecanoyl)]-4-hydroxyprolinol (Hyp-(GalNAc-alkyl)3)
cttctttttattgttcctcta

SEQ ID NO: 287 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methylcytidine-3'- phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-fluorouridine-3'-phosphate
  modified_base 8: mod_base = OTHER; note = 2'-O-methyladenosine-3'-phosphate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note 2'-O-methyluridine-3'-phosphate-N-[tris(GalNAc-alkyl)-amido decanoyl)]-4-hydroxyprolinol (Hyp-(GalNAc-alkyl)3)
tctttttattgttcctctagt

SEQ ID NO: 288 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'- phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-fluoroadenosine-3'-phosphate
  modified_base 8: mod_base = OTHER; note = 2'-O-methyluridine-3'-phosphate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluorouridine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note 2'-O-methyluridine-3'-phosphate-N-[tris(GalNAc-alkyl)-amido decanoyl)]-4-hydroxyprolinol (Hyp-(GalNAc-alkyl)3)
ctttttattgttcctctagtt

SEQ ID NO: 289 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = 2'-fluorouridine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note 2'-O-methyluridine-3'-phosphate-N-[tris(GalNAc-alkyl)-amido decanoyl)]-4-hydroxyprolinol (Hyp-(GalNAc-alkyl)3)
tttttattgttcctctagttt

SEQ ID NO: 290 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-fluorouridine-3'-phosphate
  modified_base 8: mod_base = OTHER; note = 2'-O-methylguanosine-3'-phosphate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluorocytidine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note 2'-O-methyluridine-3'-phosphate-N-[tris(GalNAc-alkyl)-amido decanoyl)]-4-hydroxyprolinol (Hyp-(GalNAc-alkyl)3)
ttttattgttcctctagttat

SEQ ID NO: 291 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-fluoroadenosine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluorocytidine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note 2'-O-methyluridine-3'-phosphate-N-[tris(GalNAc-alkyl)-amido decanoyl)]-4-hydroxyprolinol (Hyp-(GalNAc-alkyl)3)
atttcaaaaactcaacatatt

SEQ ID NO: 292 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-fluoroadenosine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note 2'-O-methyluridine-3'-phosphate-N-[tris(GalNAc-alkyl)-amido decanoyl)]-4-hydroxyprolinol (Hyp-(GalNAc-alkyl)3)
tttcaaaaactcaacatattt

SEQ ID NO: 293 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-fluoroadenosine-3'-phosphate
  modified_base 8: mod_base = OTHER; note = 2'-O-methyladenosine-3'-phosphate
  modified_base 9: mod_base = OTHER; note = 2'-fluorocytidine-3'-phosphate
  modified_base 10: mod_base = OTHER; note = 2'-fluorouridine-3'-phosphate
  modified_base 11: mod_base = OTHER; note = 2'-fluorocytidine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note 2'-O-methyluridine-3'-phosphate-N-[tris(GalNAc-alkyl)-amido decanoyl)]-4-hydroxyprolinol (Hyp-(GalNAc-alkyl)3)
ttcaaaaactcaacatatttt

SEQ ID NO: 294 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methylcytidine-3'- phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-fluoroadenosine-3'-phosphate
  modified_base 8: mod_base = OTHER; note = 2'-O-methylcytidine-3'-phosphate
  modified_base 9: mod_base = OTHER; note = 2'-fluorouridine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note 2'-O-methyluridine-3'-phosphate-N-[tris(GalNAc-alkyl)-amido decanoyl)]-4-hydroxyprolinol (Hyp-(GalNAc-alkyl)3)
tcaaaaactcaacatatttgt

SEQ ID NO: 295 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-fluorocytidine-3'-phosphate
  modified_base 8: mod_base = OTHER; note = 2'-O-methyluridine-3'-phosphate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note 2'-O-methyluridine-3'-phosphate-N-[tris(GalNAc-alkyl)-amido decanoyl)]-4-hydroxyprolinol (Hyp-(GalNAc-alkyl)3)
caaaaactcaacatatttgat

SEQ ID NO: 296 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-fluorouridine-3'-phosphate
  modified_base 8: mod_base = OTHER; note = 2'-O-methylcytidine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluorocytidine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note 2'-O-methyluridine-3'-phosphate-N-[tris(GalNAc-alkyl)-amido decanoyl)]-4-hydroxyprolinol (Hyp-(GalNAc-alkyl)3)
aaaaactcaacatatttgatt

SEQ ID NO: 297 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-fluorocytidine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note 2'-O-methyluridine-3'-phosphate-N-[tris(GalNAc-alkyl)-amido decanoyl)]-4-hydroxyprolinol (Hyp-(GalNAc-alkyl)3)
aaaactcaacatatttgatct

SEQ ID NO: 298 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-fluoroadenosine-3'-phosphate
  modified_base 8: mod_base = OTHER; note = 2'-O-methyladenosine-3'-phosphate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluorouridine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note 2'-O-methyluridine-3'-phosphate-N-[tris(GalNAc-alkyl)-amido decanoyl)]-4-hydroxyprolinol (Hyp-(GalNAc-alkyl)3)
aaactcaacatatttgatcat

SEQ ID NO: 299 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-fluoroadenosine-3'-phosphate
  modified_base 8: mod_base = OTHER; note = 2'-O-methylcytidine-3'-phosphate
  modified_base 9: mod_base = OTHER; note = 2'-fluoroadenosine-3'-phosphate
  modified_base 10: mod_base = OTHER; note = 2'-fluorouridine-3'-phosphate
  modified_base 11: mod_base = OTHER; note = 2'-fluoroadenosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note 2'-O-methyluridine-3'-phosphate-N-[tris(GalNAc-alkyl)-amido decanoyl)]-4-hydroxyprolinol (Hyp-(GalNAc-alkyl)3)
aactcaacatatttgatcagt

SEQ ID NO: 300 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methylcytidine-3'- phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-fluorocytidine-3'-phosphate
  modified_base 8: mod_base = OTHER; note = 2'-O-methyladenosine-3'-phosphate
  modified_base 9: mod_base = OTHER; note = 2'-fluorouridine-3'-phosphate
  modified_base 10: mod_base = OTHER; note = 2'-fluoroadenosine-3'-phosphate
  modified_base 11: mod_base = OTHER; note = 2'-fluorouridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note 2'-O-methyluridine-3'-phosphate-N-[tris(GalNAc-alkyl)-amido decanoyl)]-4-hydroxyprolinol (Hyp-(GalNAc-alkyl)3)
actcaacatatttgatcagtt

SEQ ID NO: 301 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methylcytidine-3'- phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-fluorouridine-3'-phosphate
  modified_base 8: mod_base = OTHER; note = 2'-O-methyladenosine-3'-phosphate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note 2'-O-methyluridine-3'-phosphate-N-[tris(GalNAc-alkyl)-amido decanoyl)]-4-hydroxyprolinol (Hyp-(GalNAc-alkyl)3)
tcaacatatttgatcagtctt

SEQ ID NO: 302 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-fluoroadenosine-3'-phosphate
  modified_base 8: mod_base = OTHER; note = 2'-O-methyluridine-3'-phosphate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note 2'-O-methyluridine-3'-phosphate-N-[tris(GalNAc-alkyl)-amido decanoyl)]-4-hydroxyprolinol (Hyp-(GalNAc-alkyl)3)
caacatatttgatcagtcttt

SEQ ID NO: 303 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = 2'-fluorouridine-3'-phosphate
  modified_base 8: mod_base = OTHER; note = 2'-O-methyluridine-3'-phosphate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluoroadenosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note 2'-O-methyluridine-3'-phosphate-N-[tris(GalNAc-alkyl)-amido decanoyl)]-4-hydroxyprolinol (Hyp-(GalNAc-alkyl)3)
aacatatttgatcagtctttt

SEQ ID NO: 304 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methylcytidine-3'- phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-fluorouridine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluorouridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note 2'-O-methyluridine-3'-phosphate-N-[tris(GalNAc-alkyl)-amido decanoyl)]-4-hydroxyprolinol (Hyp-(GalNAc-alkyl)3)
acatatttgatcagtcttttt

SEQ ID NO: 305 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-fluorouridine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluorouridine-3'-phosphate
  modified_base 11: mod_base = OTHER; note = 2'-fluorocytidine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note 2'-O-methyluridine-3'-phosphate-N-[tris(GalNAc-alkyl)-amido decanoyl)]-4-hydroxyprolinol (Hyp-(GalNAc-alkyl)3)
catatttgatcagtctttttt

SEQ ID NO: 306 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methyluridine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-fluoroguanosine-3'-phosphate
  modified_base 8: mod_base = OTHER; note = 2'-O-methyladenosine-3'-phosphate
  modified_base 9: mod_base = OTHER; note = 2'-fluorouridine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note 2'-O-methyluridine-3'-phosphate-N-[tris(GalNAc-alkyl)-amido decanoyl)]-4-hydroxyprolinol (Hyp-(GalNAc-alkyl)3)
atatttgatcagtctttttat

SEQ ID NO: 307 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methyladenosine-3'- phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-fluoroadenosine-3'-phosphate
  modified_base 8: mod_base = OTHER; note = 2'-O-methyluridine-3'-phosphate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note 2'-O-methyluridine-3'-phosphate-N-[tris(GalNAc-alkyl)-amido decanoyl)]-4-hydroxyprolinol (Hyp-(GalNAc-alkyl)3)
tatttgatcagtctttttatt

SEQ ID NO: 308 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-fluorouridine-3'-phosphate
  modified_base 8: mod_base = OTHER; note = 2'-O-methylcytidine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluorouridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note 2'-O-methyluridine-3'-phosphate-N-[tris(GalNAc-alkyl)-amido decanoyl)]-4-hydroxyprolinol (Hyp-(GalNAc-alkyl)3)
atttgatcagtctttttatgt

SEQ ID NO: 309 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-fluorocytidine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluorouridine-3'-phosphate
  modified_base 11: mod_base = OTHER; note = 2'-fluorocytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note 2'-O-methyluridine-3'-phosphate-N-[tris(GalNAc-alkyl)-amido decanoyl)]-4-hydroxyprolinol (Hyp-(GalNAc-alkyl)3)
tttgatcagtctttttatgat

SEQ ID NO: 310 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-fluoroadenosine-3'-phosphate
  modified_base 8: mod_base = OTHER; note = 2'-O-methylguanosine-3'-phosphate
  modified_base 9: mod_base = OTHER; note = 2'-fluorouridine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note 2'-O-methyluridine-3'-phosphate-N-[tris(GalNAc-alkyl)-amido decanoyl)]-4-hydroxyprolinol (Hyp-(GalNAc-alkyl)3)
ttgatcagtctttttatgatt

SEQ ID NO: 311 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methylguanosine-3'- phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-fluoroguanosine-3'-phosphate
  modified_base 8: mod_base = OTHER; note = 2'-O-methyluridine-3'-phosphate
  modified_base 9: mod_base = OTHER; note = 2'-fluorocytidine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note 2'-O-methyluridine-3'-phosphate-N-[tris(GalNAc-alkyl)-amido decanoyl)]-4-hydroxyprolinol (Hyp-(GalNAc-alkyl)3)
tgatcagtctttttatgatct

SEQ ID NO: 312 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'- phosphorothioate
  modified_base 2: mod_base = OTHER; note = 2'-O-methyladenosine-3'- phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-fluorouridine-3'-phosphate
  modified_base 8: mod_base = OTHER; note = 2'-O-methylcytidine-3'-phosphate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note 2'-O-methyladenosine-3'-phosphate-N-[tris(GalNAc-alkyl)-ami dodecanoyl)]-4-hydroxyprolinol (Hyp-(GalNAc-alkyl)3)
gatcagtctttttatgatcta

SEQ ID NO: 313 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-fluorocytidine-3'-phosphate
  modified_base 8: mod_base = OTHER; note = 2'-O-methyluridine-3'-phosphate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note 2'-O-methyluridine-3'-phosphate-N-[tris(GalNAc-alkyl)-amido decanoyl)]-4-hydroxyprolinol (Hyp-(GalNAc-alkyl)3)
atcagtctttttatgatctat

SEQ ID NO: 314 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methylcytidine-3'- phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-fluorouridine-3'-phosphate
  modified_base 8: mod_base = OTHER; note = 2'-O-methyluridine-3'-phosphate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note 2'-O-methyluridine-3'-phosphate-N-[tris(GalNAc-alkyl)-amido decanoyl)]-4-hydroxyprolinol (Hyp-(GalNAc-alkyl)3)
tcagtctttttatgatctatt

SEQ ID NO: 315 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-fluorouridine-3'-phosphate
  modified_base 8: mod_base = OTHER; note = 2'-O-methyluridine-3'-phosphate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluoroadenosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note 2'-O-methyluridine-3'-phosphate-N-[tris(GalNAc-alkyl)-amido decanoyl)]-4-hydroxyprolinol (Hyp-(GalNAc-alkyl)3)
cagtctttttatgatctatct

SEQ ID NO: 316 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methylguanosine-3'- phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-fluorouridine-3'-phosphate
  modified_base 8: mod_base = OTHER; note = 2'-O-methyluridine-3'-phosphate
  modified_base 9: mod_base = OTHER; note = 2'-fluorouridine-3'-phosphate
  modified_base 10: mod_base = OTHER; note = 2'-fluoroadenosine-3'-phosphate
  modified_base 11: mod_base = OTHER; note = 2'-fluorouridine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylguanosine-3'-phosphate
  modified_base 21: mod_base = OTHER; note 2'-O-methyluridine-3'-phosphate-N-[tris(GalNAc-alkyl)-amido decanoyl)]-4-hydroxyprolinol (Hyp-(GalNAc-alkyl)3)
agtctttttatgatctatcgt

SEQ ID NO: 317 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'- phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-fluorouridine-3'-phosphate
  modified_base 8: mod_base = OTHER; note = 2'-O-methyluridine-3'-phosphate
  modified_base 9: mod_base = OTHER; note = 2'-fluoroadenosine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note 2'-O-methyluridine-3'-phosphate-N-[tris(GalNAc-alkyl)-amido decanoyl)]-4-hydroxyprolinol (Hyp-(GalNAc-alkyl)3)
gtctttttatgatctatcgct

SEQ ID NO: 318 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methylcytidine-3'- phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-fluorouridine-3'-phosphate
  modified_base 8: mod_base = OTHER; note = 2'-O-methyladenosine-3'-phosphate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluoroadenosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note 2'-O-methyluridine-3'-phosphate-N-[tris(GalNAc-alkyl)-amido decanoyl)]-4-hydroxyprolinol (Hyp-(GalNAc-alkyl)3)
tctttttatgatctatcgctt

SEQ ID NO: 319 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'- phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-fluoroadenosine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluorouridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note 2'-O-methyluridine-3'-phosphate-N-[tris(GalNAc-alkyl)-amido decanoyl)]-4-hydroxyprolinol (Hyp-(GalNAc-alkyl)3)
ctttttatgatctatcgctgt

SEQ ID NO: 320 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = 2'-fluoroadenosine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluorocytidine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note 2'-O-methyluridine-3'-phosphate-N-[tris(GalNAc-alkyl)-amido decanoyl)]-4-hydroxyprolinol (Hyp-(GalNAc-alkyl)3)
aactccagaacacccagaagt

SEQ ID NO: 321 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methylcytidine-3'- phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-fluoroguanosine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note 2'-O-methyladenosine-3'-phosphate-N-[tris(GalNAc-alkyl)-ami dodecanoyl)]-4-hydroxyprolinol (Hyp-(GalNAc-alkyl)3)
actccagaacacccagaagta

SEQ ID NO: 322 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'- phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-fluoroadenosine-3'-phosphate
  modified_base 8: mod_base = OTHER; note = 2'-O-methyladenosine-3'-phosphate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluorocytidine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note 2'-O-methyladenosine-3'-phosphate-N-[tris(GalNAc-alkyl)-ami dodecanoyl)]-4-hydroxyprolinol (Hyp-(GalNAc-alkyl)3)
ctccagaacacccagaagtaa

SEQ ID NO: 323 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methylcytidine-3'- phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-fluoroadenosine-3'-phosphate
  modified_base 8: mod_base = OTHER; note = 2'-O-methylcytidine-3'-phosphate
  modified_base 9: mod_base = OTHER; note = 2'-fluoroadenosine-3'-phosphate
  modified_base 10: mod_base = OTHER; note = 2'-fluorocytidine-3'-phosphate
  modified_base 11: mod_base = OTHER; note = 2'-fluorocytidine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note 2'-O-methyluridine-3'-phosphate-N-[tris(GalNAc-alkyl)-amido decanoyl)]-4-hydroxyprolinol (Hyp-(GalNAc-alkyl)3)
tccagaacacccagaagtaat

SEQ ID NO: 324 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'- phosphorothioate
  modified_base 2: mod_base = OTHER; note = 2'-O-methylcytidine-3'- phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-fluorocytidine-3'-phosphate
  modified_base 8: mod_base = OTHER; note = 2'-O-methyladenosine-3'-phosphate
  modified_base 9: mod_base = OTHER; note = 2'-fluorocytidine-3'-phosphate
  modified_base 10: mod_base = OTHER; note = 2'-fluorocytidine-3'-phosphate
  modified_base 11: mod_base = OTHER; note = 2'-fluorocytidine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note 2'-O-methyluridine-3'-phosphate-N-[tris(GalNAc-alkyl)-amido decanoyl)]-4-hydroxyprolinol (Hyp-(GalNAc-alkyl)3)
ccagaacacccagaagtaact

SEQ ID NO: 325 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-fluoroadenosine-3'-phosphate
  modified_base 8: mod_base = OTHER; note = 2'-O-methylcytidine-3'-phosphate
  modified_base 9: mod_base = OTHER; note = 2'-fluorocytidine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note 2'-O-methyluridine-3'-phosphate-N-[tris(GalNAc-alkyl)-amido decanoyl)]-4-hydroxyprolinol (Hyp-(GalNAc-alkyl)3)
cagaacacccagaagtaactt

SEQ ID NO: 326 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methylguanosine-3'- phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-fluorocytidine-3'-phosphate
  modified_base 8: mod_base = OTHER; note = 2'-O-methylcytidine-3'-phosphate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note 2'-O-methyluridine-3'-phosphate-N-[tris(GalNAc-alkyl)-amido decanoyl)]-4-hydroxyprolinol (Hyp-(GalNAc-alkyl)3)
agaacacccagaagtaacttt

SEQ ID NO: 327 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'- phosphorothioate
  modified_base 2: mod_base = OTHER; note = 2'-O-methyladenosine-3'- phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-fluorocytidine-3'-phosphate
  modified_base 8: mod_base = OTHER; note = 2'-O-methylcytidine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluoroadenosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note 2'-O-methyladenosine-3'-phosphate-N-[tris(GalNAc-alkyl)-ami dodecanoyl)]-4-hydroxyprolinol (Hyp-(GalNAc-alkyl)3)
gaacacccagaagtaacttca

SEQ ID NO: 328 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = 2'-fluorocytidine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note 2'-O-methyluridine-3'-phosphate-N-[tris(GalNAc-alkyl)-amido decanoyl)]-4-hydroxyprolinol (Hyp-(GalNAc-alkyl)3)
aacacccagaagtaacttcat

SEQ ID NO: 329 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methylcytidine-3'- phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = 2'-fluoroadenosine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note 2'-O-methyluridine-3'-phosphate-N-[tris(GalNAc-alkyl)-amido decanoyl)]-4-hydroxyprolinol (Hyp-(GalNAc-alkyl)3)
acacccagaagtaacttcact

SEQ ID NO: 330 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-fluoroguanosine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluorouridine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note 2'-O-methyluridine-3'-phosphate-N-[tris(GalNAc-alkyl)-amido decanoyl)]-4-hydroxyprolinol (Hyp-(GalNAc-alkyl)3)
cacccagaagtaacttcactt

SEQ ID NO: 331 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methylcytidine-3'- phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-fluoroadenosine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluorouridine-3'-phosphate
  modified_base 11: mod_base = OTHER; note = 2'-fluoroadenosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note 2'-O-methyluridine-3'-phosphate-N-[tris(GalNAc-alkyl)-amido decanoyl)]-4-hydroxyprolinol (Hyp-(GalNAc-alkyl)3)
acccagaagtaacttcacttt

SEQ ID NO: 332 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'- phosphorothioate
  modified_base 2: mod_base = OTHER; note = 2'-O-methylcytidine-3'- phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-fluoroadenosine-3'-phosphate
  modified_base 8: mod_base = OTHER; note = 2'-O-methylguanosine-3'-phosphate
  modified_base 9: mod_base = OTHER; note = 2'-fluorouridine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note 2'-O-methyladenosine-3'-phosphate-N-[tris(GalNAc-alkyl)-ami dodecanoyl)]-4-hydroxyprolinol (Hyp-(GalNAc-alkyl)3)
cccagaagtaacttcacttaa

SEQ ID NO: 333 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'- phosphorothioate
  modified_base 2: mod_base = OTHER; note = 2'-O-methylcytidine-3'- phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-fluoroguanosine-3'-phosphate
  modified_base 8: mod_base = OTHER; note = 2'-O-methyluridine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluorocytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note 2'-O-methyladenosine-3'-phosphate-N-[tris(GalNAc-alkyl)-ami dodecanoyl)]-4-hydroxyprolinol (Hyp-(GalNAc-alkyl)3)
ccagaagtaacttcacttaaa

SEQ ID NO: 334 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-fluorouridine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note 2'-O-methyladenosine-3'-phosphate-N-[tris(GalNAc-alkyl)-ami dodecanoyl)]-4-hydroxyprolinol (Hyp-(GalNAc-alkyl)3)
cagaagtaacttcacttaaaa

SEQ ID NO: 335 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methylguanosine-3'- phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-fluoroadenosine-3'-phosphate
  modified_base 8: mod_base = OTHER; note = 2'-O-methyladenosine-3'-phosphate
  modified_base 9: mod_base = OTHER; note = 2'-fluorocytidine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note 2'-O-methyluridine-3'-phosphate-N-[tris(GalNAc-alkyl)-amido decanoyl)]-4-hydroxyprolinol (Hyp-(GalNAc-alkyl)3)
agaagtaacttcacttaaaat

SEQ ID NO: 336 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'- phosphorothioate
  modified_base 2: mod_base = OTHER; note = 2'-O-methyladenosine-3'- phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = 2'-fluoroadenosine-3'-phosphate
  modified_base 8: mod_base = OTHER; note = 2'-O-methylcytidine-3'-phosphate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluorocytidine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note 2'-O-methyluridine-3'-phosphate-N-[tris(GalNAc-alkyl)-amido decanoyl)]-4-hydroxyprolinol (Hyp-(GalNAc-alkyl)3)
gaagtaacttcacttaaaact

SEQ ID NO: 337 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-fluorocytidine-3'-phosphate
  modified_base 8: mod_base = OTHER; note = 2'-O-methyluridine-3'-phosphate
  modified_base 9: mod_base = OTHER; note = 2'-fluorouridine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note 2'-O-methyluridine-3'-phosphate-N-[tris(GalNAc-alkyl)-amido decanoyl)]-4-hydroxyprolinol (Hyp-(GalNAc-alkyl)3)
aagtaacttcacttaaaactt

SEQ ID NO: 338 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methylguanosine-3'- phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-fluorouridine-3'-phosphate
  modified_base 8: mod_base = OTHER; note = 2'-O-methyluridine-3'-phosphate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluorocytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note 2'-O-methyluridine-3'-phosphate-N-[tris(GalNAc-alkyl)-amido decanoyl)]-4-hydroxyprolinol (Hyp-(GalNAc-alkyl)3)
agtaacttcacttaaaacttt

SEQ ID NO: 339 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'- phosphorothioate
  modified_base 2: mod_base = OTHER; note = 2'-O-methyluridine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-fluorouridine-3'-phosphate
  modified_base 8: mod_base = OTHER; note = 2'-O-methylcytidine-3'-phosphate
  modified_base 9: mod_base = OTHER; note = 2'-fluoroadenosine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note 2'-O-methyluridine-3'-phosphate-N-[tris(GalNAc-alkyl)-amido decanoyl)]-4-hydroxyprolinol (Hyp-(GalNAc-alkyl)3)
gtaacttcacttaaaactttt

SEQ ID NO: 340 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methyladenosine-3'- phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-fluorocytidine-3'-phosphate
  modified_base 8: mod_base = OTHER; note = 2'-O-methyladenosine-3'-phosphate
  modified_base 9: mod_base = OTHER; note = 2'-fluorocytidine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note 2'-O-methyluridine-3'-phosphate-N-[tris(GalNAc-alkyl)-amido decanoyl)]-4-hydroxyprolinol (Hyp-(GalNAc-alkyl)3)
taacttcacttaaaacttttt

SEQ ID NO: 341 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-fluoroadenosine-3'-phosphate
  modified_base 8: mod_base = OTHER; note = 2'-O-methylcytidine-3'-phosphate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluoroadenosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note 2'-O-methyluridine-3'-phosphate-N-[tris(GalNAc-alkyl)-amido decanoyl)]-4-hydroxyprolinol (Hyp-(GalNAc-alkyl)3)
aacttcacttaaaacttttgt

SEQ ID NO: 342 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methylcytidine-3'- phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-fluorocytidine-3'-phosphate
  modified_base 8: mod_base = OTHER; note = 2'-O-methyluridine-3'-phosphate
  modified_base 9: mod_base = OTHER; note = 2'-fluorouridine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note 2'-O-methyluridine-3'-phosphate-N-[tris(GalNAc-alkyl)-amido decanoyl)]-4-hydroxyprolinol (Hyp-(GalNAc-alkyl)3)
acttcacttaaaacttttgtt

SEQ ID NO: 343 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'- phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-fluorouridine-3'-phosphate
  modified_base 8: mod_base = OTHER; note = 2'-O-methyluridine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note 2'-O-methyluridine-3'-phosphate-N-[tris(GalNAc-alkyl)-amido decanoyl)]-4-hydroxyprolinol (Hyp-(GalNAc-alkyl)3)
cttcacttaaaacttttgtat

SEQ ID NO: 344 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-fluorouridine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note 2'-O-methyluridine-3'-phosphate-N-[tris(GalNAc-alkyl)-amido decanoyl)]-4-hydroxyprolinol (Hyp-(GalNAc-alkyl)3)
ttcacttaaaacttttgtagt

SEQ ID NO: 345 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methylcytidine-3'- phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-fluoroadenosine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluorocytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note 2'-O-methyluridine-3'-phosphate-N-[tris(GalNAc-alkyl)-amido decanoyl)]-4-hydroxyprolinol (Hyp-(GalNAc-alkyl)3)
tcacttaaaacttttgtagat

SEQ ID NO: 346 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = 2'-fluoroadenosine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note 2'-O-methyladenosine-3'-phosphate-N-[tris(GalNAc-alkyl)-ami dodecanoyl)]-4-hydroxyprolinol (Hyp-(GalNAc-alkyl)3)
cacttaaaacttttgtagaaa

SEQ ID NO: 347 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methylcytidine-3'- phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-fluoroadenosine-3'-phosphate
  modified_base 8: mod_base = OTHER; note = 2'-O-methyladenosine-3'-phosphate
  modified_base 9: mod_base = OTHER; note = 2'-fluorocytidine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note 2'-O-methyladenosine-3'-phosphate-N-[tris(GalNAc-alkyl)-ami dodecanoyl)]-4-hydroxyprolinol (Hyp-(GalNAc-alkyl)3)
acttaaaacttttgtagaaaa

SEQ ID NO: 348 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note 2'-O-methyluridine-3'-phosphate-N-[tris(GalNAc-alkyl)-amido decanoyl)]-4-hydroxyprolinol (Hyp-(GalNAc-alkyl)3)
aatgttcacaattaagctcct

SEQ ID NO: 349 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluorouridine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note 2'-O-methyluridine-3'-phosphate-N-[tris(GalNAc-alkyl)-amido decanoyl)]-4-hydroxyprolinol (Hyp-(GalNAc-alkyl)3)
atttgctatgttagacgatgt

SEQ ID NO: 350 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluoroadenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note 2'-O-methyladenosine-3'-phosphate-N-[tris(GalNAc-alkyl)-ami dodecanoyl)]-4-hydroxyprolinol (Hyp-(GalNAc-alkyl)3)
ttgctatgttagacgatgtaa

SEQ ID NO: 351 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methylguanosine-3'- phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-fluorouridine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note 2'-O-methyladenosine-3'-phosphate-N-[tris(GalNAc-alkyl)-ami dodecanoyl)]-4-hydroxyprolinol (Hyp-(GalNAc-alkyl)3)
tgctatgttagacgatgtaaa

SEQ ID NO: 352 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluoroadenosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note 2'-O-methyladenosine-3'-phosphate-N-[tris(GalNAc-alkyl)-ami dodecanoyl)]-4-hydroxyprolinol (Hyp-(GalNAc-alkyl)3)
aactgagaagaactacatata

SEQ ID NO: 353 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note 2'-O-methyladenosine-3'-phosphate-N-[tris(GalNAc-alkyl)-ami dodecanoyl)]-4-hydroxyprolinol (Hyp-(GalNAc-alkyl)3)
aaccaacagcatagtcaaata

SEQ ID NO: 354 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'- phosphorothioate
  modified_base 2: mod_base = OTHER; note = 2'-O-methylcytidine-3'- phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluorouridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note 2'-O-methyluridine-3'-phosphate-N-[tris(GalNAc-alkyl)-amido decanoyl)]-4-hydroxyprolinol (Hyp-(GalNAc-alkyl)3)
cccacagaaatttctctatct

SEQ ID NO: 355 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-fluorocytidine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note 2'-O-methyladenosine-3'-phosphate-N-[tris(GalNAc-alkyl)-ami dodecanoyl)]-4-hydroxyprolinol (Hyp-(GalNAc-alkyl)3)
caggtagtccatggacattaa

SEQ ID NO: 356 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'- phosphorothioate
  modified_base 2: mod_base = OTHER; note = 2'-O-methylguanosine-3'- phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-O-methylcytidine-3'-phosphate
  modified_base 8: mod_base = OTHER; note = 2'-O-methylcytidine-3'-phosphate
  modified_base 9: mod_base = OTHER; note = 2'-fluoroadenosine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note 2'-O-methyluridine-3'-phosphate-N-[tris(GalNAc-alkyl)-amido decanoyl)]-4-hydroxyprolinol (Hyp-(GalNAc-alkyl)3)
ggtagtccatggacattaatt

SEQ ID NO: 357 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methylguanosine-3'- phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluorocytidine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note 2'-O-methyladenosine-3'-phosphate-N-[tris(GalNAc-alkyl)-ami dodecanoyl)]-4-hydroxyprolinol (Hyp-(GalNAc-alkyl)3)
agttggaagactggaaagaca

SEQ ID NO: 358 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methylguanosine-3'- phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note 2'-O-methyluridine-3'-phosphate-N-[tris(GalNAc-alkyl)-amido decanoyl)]-4-hydroxyprolinol (Hyp-(GalNAc-alkyl)3)
tggaaagacaacaaacattat

SEQ ID NO: 359 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-fluoroguanosine-3'-phosphate
  modified_base 10: mod_base = OTHER; note = 2'-fluoroguanosine-3'-phosphate
  modified_base 11: mod_base = OTHER; note = 2'-fluoroadenosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note 2'-O-methyladenosine-3'-phosphate-N-[tris(GalNAc-alkyl)-ami dodecanoyl)]-4-hydroxyprolinol (Hyp-(GalNAc-alkyl)3)
tttacttgggaaatcacgaaa

SEQ ID NO: 360 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'- phosphorothioate
  modified_base 2: mod_base = OTHER; note = 2'-O-methylguanosine-3'- phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-fluoroadenosine-3'-phosphate
  modified_base 10: mod_base = OTHER; note = 2'-fluorocytidine-3'-phosphate
  modified_base 11: mod_base = OTHER; note = 2'-fluoroguanosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note 2'-O-methyladenosine-3'-phosphate-N-[tris(GalNAc-alkyl)-ami dodecanoyl)]-4-hydroxyprolinol (Hyp-(GalNAc-alkyl)3)
gggaaatcacgaaaccaacta

SEQ ID NO: 361 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'- phosphorothioate
  modified_base 2: mod_base = OTHER; note = 2'-O-methyladenosine-3'- phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note 2'-O-methyladenosine-3'-phosphate-N-[tris(GalNAc-alkyl)-ami dodecanoyl)]-4-hydroxyprolinol (Hyp-(GalNAc-alkyl)3)
gaaatcacgaaaccaactata

SEQ ID NO: 362 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'- phosphorothioate
  modified_base 2: mod_base = OTHER; note = 2'-O-methylguanosine-3'- phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note 2'-O-methyladenosine-3'-phosphate-N-[tris(GalNAc-alkyl)-ami dodecanoyl)]-4-hydroxyprolinol (Hyp-(GalNAc-alkyl)3)
cgaaaccaactatacgctaca

SEQ ID NO: 363 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note 2'-O-methyladenosine-3'-phosphate-N-[tris(GalNAc-alkyl)-ami dodecanoyl)]-4-hydroxyprolinol (Hyp-(GalNAc-alkyl)3)
atcaaccaaaatgttgatcca

SEQ ID NO: 364 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-fluorocytidine-3'-phosphate
  modified_base 10: mod_base = OTHER; note = 2'-fluorouridine-3'-phosphate
  modified_base 11: mod_base = OTHER; note = 2'-fluoroadenosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note 2'-O-methyladenosine-3'-phosphate-N-[tris(GalNAc-alkyl)-ami dodecanoyl)]-4-hydroxyprolinol (Hyp-(GalNAc-alkyl)3)
ttaaaactctaaacttgacta

SEQ ID NO: 365 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note 2'-O-methyluridine-3'-phosphate-N-[tris(GalNAc-alkyl)-amido decanoyl)]-4-hydroxyprolinol (Hyp-(GalNAc-alkyl)3)
caaaacttgaaagcctcctat

SEQ ID NO: 366 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methylcytidine-3'- phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note 2'-O-methyluridine-3'-phosphate-N-[tris(GalNAc-alkyl)-amido decanoyl)]-4-hydroxyprolinol (Hyp-(GalNAc-alkyl)3)
tcaacatcgaatagatggatt

SEQ ID NO: 367 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note 2'-O-methyluridine-3'-phosphate-N-[tris(GalNAc-alkyl)-amido decanoyl)]-4-hydroxyprolinol (Hyp-(GalNAc-alkyl)3)
caaaacttcaatgaaacgtgt

SEQ ID NO: 368 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluorocytidine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note 2'-O-methyluridine-3'-phosphate-N-[tris(GalNAc-alkyl)-amido decanoyl)]-4-hydroxyprolinol (Hyp-(GalNAc-alkyl)3)
aatcacgaaaccaactatact

SEQ ID NO: 369 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylguanosine-3'- phosphorothioate
  modified_base 2: mod_base = OTHER; note = 2'-O-methylguanosine-3'- phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note 2'-O-methyluridine-3'-phosphate-N-[tris(GalNAc-alkyl)-amido decanoyl)]-4-hydroxyprolinol (Hyp-(GalNAc-alkyl)3)
gggaatcaattttagatggtt

SEQ ID NO: 370 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluoroadenosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note 2'-O-methyluridine-3'-phosphate-N-[tris(GalNAc-alkyl)-amido decanoyl)]-4-hydroxyprolinol (Hyp-(GalNAc-alkyl)3)
caaaatgttgatccatccaat

SEQ ID NO: 371 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methylguanosine-3'- phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluorouridine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylguanosine-3'-phosphate
  modified_base 21: mod_base = OTHER; note 2'-O-methyladenosine-3'-phosphate-N-[tris(GalNAc-alkyl)-ami dodecanoyl)]-4-hydroxyprolinol (Hyp-(GalNAc-alkyl)3)
tggacattaattcaacatcga

SEQ ID NO: 372 - RNA, 23 nt, synthetic construct
  source 1..23: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-fluorouridine -3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-fluorouridine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methyluridine-3'-phosphate
  modified_base 16: mod_base = OTHER; note = 2'-fluorouridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  modified_base 23: mod_base = OTHER; note = 2'-O-methyluridine-3'-phosphate
attaattgtgaacatttttatct

SEQ ID NO: 373 - RNA, 23 nt, synthetic construct
  source 1..23: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-fluorocytidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-fluoroadenosine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-fluorouridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyladenosine-3'- phosphorothioate
  modified_base 22: mod_base = OTHER; note = 2'-O-methyluridine-3'-phosphorothioate
  modified_base 23: mod_base = OTHER; note = 2'-O-methylcytidine-3'-phosphate
acttaattgtgaacatttttatc

SEQ ID NO: 374 - RNA, 23 nt, synthetic construct
  source 1..23: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-fluoroadenosine-3'-phosphate
  modified_base 7: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-fluoroadenosine-3'-phosphate
  modified_base 15: mod_base = OTHER; note = 2'-O-methylcytidine-3'-phosphate
  modified_base 16: mod_base = OTHER; note = 2'-fluoroadenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methyladenosine-3'- phosphorothioate
  modified_base 23: mod_base = OTHER; note = 2'-O-methyluridine-3'-phosphate
agcttaattgtgaacatttttat

SEQ ID NO: 375 - RNA, 23 nt, synthetic construct
  source 1..23: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-fluorouridine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-fluoroadenosine-3'-phosphate
  modified_base 15: mod_base = OTHER; note = 2'-O-methyladenosine-3'-phosphate
  modified_base 16: mod_base = OTHER; note = 2'-fluorocytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyladenosine-3'-phosphate
aagcttaattgtgaacattttta

SEQ ID NO: 376 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = Thymidine-glycol nucleic acid (GNA) S-Isomer
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-fluoroguanosine-3'-phosphate
  modified_base 15: mod_base = OTHER; note = 2'-O-methyladenosine-3'-phosphate
  modified_base 16: mod_base = OTHER; note = 2'-fluoroadenosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
  misc_feature 1..4: note = RNA
  misc_feature 5: note = DNA
  misc_feature 6..23: note = RNA
agagcttaattgtgaacattttt

SEQ ID NO: 377 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = cytidine-2'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-fluoroguanosine-3'-phosphate
  modified_base 15: mod_base = OTHER; note = 2'-O-methyluridine-3'-phosphate
  modified_base 16: mod_base = OTHER; note = 2'-fluoroguanosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
  misc_feature 1..4: note = RNA
  misc_feature 5: note = DNA
  misc_feature 6..23: note = RNA
aaggagcttaattgtgaacattt

SEQ ID NO: 378 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = guanosine-2'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-fluorouridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyladenosine-3'- phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
  misc_feature 1..4: note = RNA
  misc_feature 5: note = DNA
  misc_feature 6..23: note = RNA
aaaggagcttaattgtgaacatt

SEQ ID NO: 379 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = Adenosine-glycol nucleic acid (GNA) S-Isomer
  modified_base 8: mod_base = OTHER; note = 2'-O-methylguanosine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-fluoroguanosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methylcytidine-3'- phosphorothioate
  modified_base 22: mod_base = OTHER; note = 2'-O-methyladenosine-3'- phosphorothioate
  modified_base 23: mod_base = OTHER; note = 2'-O-methyluridine-3'-phosphate
  misc_feature 1..4: note = RNA
  misc_feature 5: note = DNA
  misc_feature 6..23: note = RNA
agaaggagcttaattgtgaacat

SEQ ID NO: 380 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = guanosine-2'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-fluoroadenosine-3'-phosphate
  modified_base 15: mod_base = OTHER; note = 2'-O-methyluridine-3'-phosphate
  modified_base 16: mod_base = OTHER; note = 2'-fluorouridine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyladenosine-3'- phosphorothioate
  modified_base 22: mod_base = OTHER; note = 2'-O-methylcytidine-3'- phosphorothioate
  modified_base 23: mod_base = OTHER; note = 2'-O-methyladenosine-3'-phosphate
  misc_feature 1..4: note = RNA
  misc_feature 5: note = DNA
  misc_feature 6..23: note = RNA
aagaaggagcttaattgtgaaca

SEQ ID NO: 381 - RNA, 23 nt, synthetic construct
  source 1..23: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-fluoroadenosine-3'-phosphate
  modified_base 7: mod_base = OTHER; note = 2'-O-methylguanosine-3'-phosphate
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-fluoroadenosine-3'-phosphate
  modified_base 15: mod_base = OTHER; note = 2'-O-methyladenosine-3'-phosphate
  modified_base 16: mod_base = OTHER; note = 2'-fluorouridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyladenosine-3'- phosphorothioate
  modified_base 22: mod_base = OTHER; note = 2'-O-methyladenosine-3'- phosphorothioate
  modified_base 23: mod_base = OTHER; note = 2'-O-methylcytidine-3'-phosphate
aaagaaggagcttaattgtgaac

SEQ ID NO: 382 - RNA, 23 nt, synthetic construct
  source 1..23: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-fluoroadenosine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methyladenosine-3'-phosphate
  modified_base 16: mod_base = OTHER; note = 2'-fluoroadenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methylguanosine-3'- phosphorothioate
  modified_base 22: mod_base = OTHER; note = 2'-O-methyladenosine-3'- phosphorothioate
  modified_base 23: mod_base = OTHER; note = 2'-O-methyladenosine-3'-phosphate
aaaagaaggagcttaattgtgaa

SEQ ID NO: 383 - RNA, 23 nt, synthetic construct
  source 1..23: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-fluoroguanosine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-fluoroadenosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  modified_base 23: mod_base = OTHER; note = 2'-O-methyladenosine-3'-phosphate
aaaaagaaggagcttaattgtga

SEQ ID NO: 384 - RNA, 23 nt, synthetic construct
  source 1..23: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-fluoroadenosine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-fluorocytidine-3'-phosphate
  modified_base 15: mod_base = OTHER; note = 2'-O-methyluridine-3'-phosphate
  modified_base 16: mod_base = OTHER; note = 2'-fluorouridine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylguanosine-3'- phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
aaaaaagaaggagcttaattgtg

SEQ ID NO: 385 - RNA, 23 nt, synthetic construct
  source 1..23: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-fluorouridine -3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-fluoroadenosine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-fluoroguanosine-3'-phosphate
  modified_base 15: mod_base = OTHER; note = 2'-O-methylcytidine-3'-phosphate
  modified_base 16: mod_base = OTHER; note = 2'-fluorouridine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  modified_base 23: mod_base = OTHER; note = 2'-O-methyluridine-3'-phosphate
ataaaaagaaggagcttaattgt

SEQ ID NO: 386 - RNA, 23 nt, synthetic construct
  source 1..23: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-fluoroadenosine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-fluoroadenosine-3'-phosphate
  modified_base 15: mod_base = OTHER; note = 2'-O-methylguanosine-3'-phosphate
  modified_base 16: mod_base = OTHER; note = 2'-fluorocytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
aataaaaagaaggagcttaattg

SEQ ID NO: 387 - RNA, 23 nt, synthetic construct
  source 1..23: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-fluoroadenosine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-fluoroguanosine-3'-phosphate
  modified_base 15: mod_base = OTHER; note = 2'-O-methyladenosine-3'-phosphate
  modified_base 16: mod_base = OTHER; note = 2'-fluoroguanosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyladenosine-3'- phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
aaataaaaagaaggagcttaatt

SEQ ID NO: 388 - RNA, 23 nt, synthetic construct
  source 1..23: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-fluorocytidine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-fluoroadenosine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-fluoroguanosine-3'-phosphate
  modified_base 15: mod_base = OTHER; note = 2'-O-methylguanosine-3'-phosphate
  modified_base 16: mod_base = OTHER; note = 2'-fluoroadenosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyladenosine-3'- phosphorothioate
  modified_base 22: mod_base = OTHER; note = 2'-O-methyladenosine-3'- phosphorothioate
  modified_base 23: mod_base = OTHER; note = 2'-O-methyluridine-3'-phosphate
acaataaaaagaaggagcttaat

SEQ ID NO: 389 - RNA, 23 nt, synthetic construct
  source 1..23: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-fluoroadenosine-3'-phosphate
  modified_base 7: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-fluoroguanosine-3'-phosphate
  modified_base 15: mod_base = OTHER; note = 2'-O-methyladenosine-3'-phosphate
  modified_base 16: mod_base = OTHER; note = 2'-fluoroadenosine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methylcytidine-3'- phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
agaacaataaaaagaaggagctt

SEQ ID NO: 390 - RNA, 23 nt, synthetic construct
  source 1..23: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-fluorocytidine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-fluoroadenosine-3'-phosphate
  modified_base 15: mod_base = OTHER; note = 2'-O-methylguanosine-3'-phosphate
  modified_base 16: mod_base = OTHER; note = 2'-fluoroadenosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methylguanosine-3'- phosphorothioate
  modified_base 22: mod_base = OTHER; note = 2'-O-methylcytidine-3'- phosphorothioate
  modified_base 23: mod_base = OTHER; note = 2'-O-methyluridine-3'-phosphate
aggaacaataaaaagaaggagct

SEQ ID NO: 391 - RNA, 23 nt, synthetic construct
  source 1..23: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-fluoroadenosine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-fluoroadenosine-3'-phosphate
  modified_base 15: mod_base = OTHER; note = 2'-O-methyladenosine-3'-phosphate
  modified_base 16: mod_base = OTHER; note = 2'-fluoroguanosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyladenosine-3'- phosphorothioate
  modified_base 22: mod_base = OTHER; note = 2'-O-methylguanosine-3'- phosphorothioate
  modified_base 23: mod_base = OTHER; note = 2'-O-methylcytidine-3'-phosphate
aaggaacaataaaaagaaggagc

SEQ ID NO: 392 - RNA, 23 nt, synthetic construct
  source 1..23: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-fluoroadenosine-3'-phosphate
  modified_base 7: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-fluoroadenosine-3'-phosphate
  modified_base 15: mod_base = OTHER; note = 2'-O-methyladenosine-3'-phosphate
  modified_base 16: mod_base = OTHER; note = 2'-fluoroadenosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methylguanosine-3'- phosphorothioate
  modified_base 22: mod_base = OTHER; note = 2'-O-methyladenosine-3'- phosphorothioate
  modified_base 23: mod_base = OTHER; note = 2'-O-methylguanosine-3'-phosphate
agaggaacaataaaaagaaggag

SEQ ID NO: 393 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyluridine-3'-phosphorothioate
  modified_base 2: mod_base = OTHER; note = 2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = Adenosine-glycol nucleic acid (GNA) S-Isomer
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-fluoroadenosine-3'-phosphate
  modified_base 15: mod_base = OTHER; note = 2'-O-methyladenosine-3'-phosphate
  modified_base 16: mod_base = OTHER; note = 2'-fluoroadenosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methylguanosine-3'- phosphorothioate
  modified_base 22: mod_base = OTHER; note = 2'-O-methylguanosine-3'- phosphorothioate
  modified_base 23: mod_base = OTHER; note = 2'-O-methyladenosine-3'-phosphate
  misc_feature 1..4: note = RNA
  misc_feature 5: note = DNA
  misc_feature 6..23: note = RNA
tagaggaacaataaaaagaagga

SEQ ID NO: 394 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-fluorocytidine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = guanosine-2'-phosphate
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-fluorouridine-3'-phosphate
  modified_base 15: mod_base = OTHER; note = 2'-O-methyladenosine-3'-phosphate
  modified_base 16: mod_base = OTHER; note = 2'-fluoroadenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyladenosine-3'- phosphorothioate
  modified_base 22: mod_base = OTHER; note = 2'-O-methyladenosine-3'- phosphorothioate
  modified_base 23: mod_base = OTHER; note = 2'-O-methylguanosine-3'-phosphate
  misc_feature 1..4: note = RNA
  misc_feature 5: note = DNA
  misc_feature 6..23: note = RNA
actagaggaacaataaaaagaag

SEQ ID NO: 395 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = Adenosine-glycol nucleic acid (GNA) S-Isomer
  modified_base 8: mod_base = OTHER; note = 2'-O-methylguanosine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-fluoroadenosine-3'-phosphate
  modified_base 15: mod_base = OTHER; note = 2'-O-methyluridine-3'-phosphate
  modified_base 16: mod_base = OTHER; note = 2'-fluoroadenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methylguanosine-3'- phosphorothioate
  modified_base 22: mod_base = OTHER; note = 2'-O-methyladenosine-3'- phosphorothioate
  modified_base 23: mod_base = OTHER; note = 2'-O-methyladenosine-3'-phosphate
  misc_feature 1..4: note = RNA
  misc_feature 5: note = DNA
  misc_feature 6..23: note = RNA
aactagaggaacaataaaaagaa

SEQ ID NO: 396 - RNA, 23 nt, synthetic construct
  source 1..23: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-fluoroadenosine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methyladenosine-3'-phosphate
  modified_base 16: mod_base = OTHER; note = 2'-fluorouridine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyladenosine-3'- phosphorothioate
  modified_base 22: mod_base = OTHER; note = 2'-O-methylguanosine-3'- phosphorothioate
  modified_base 23: mod_base = OTHER; note = 2'-O-methyladenosine-3'-phosphate
aaactagaggaacaataaaaaga

SEQ ID NO: 397 - RNA, 23 nt, synthetic construct
  source 1..23: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-fluorouridine -3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-fluorouridine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-fluoroadenosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyladenosine-3'- phosphorothioate
  modified_base 22: mod_base = OTHER; note = 2'-O-methyladenosine-3'- phosphorothioate
  modified_base 23: mod_base = OTHER; note = 2'-O-methylguanosine-3'-phosphate
ataactagaggaacaataaaaag

SEQ ID NO: 398 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = Thymidine-glycol nucleic acid (GNA) S-Isomer
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-fluorouridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methyladenosine-3'- phosphorothioate
  modified_base 23: mod_base = OTHER; note = 2'-O-methyluridine-3'-phosphate
  misc_feature 1..4: note = RNA
  misc_feature 5: note = DNA
  misc_feature 6..23: note = RNA
aatatgttgagtttttgaaatat

SEQ ID NO: 399 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = guanosine-2'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-fluorouridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyladenosine-3'- phosphorothioate
  modified_base 22: mod_base = OTHER; note = 2'-O-methyluridine-3'-phosphorothioate
  modified_base 23: mod_base = OTHER; note = 2'-O-methyladenosine-3'-phosphate
  misc_feature 1..4: note = RNA
  misc_feature 5: note = DNA
  misc_feature 6..23: note = RNA
aaatatgttgagtttttgaaata

SEQ ID NO: 400 - RNA, 23 nt, synthetic construct
  source 1..23: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-fluoroadenosine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-fluorouridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyladenosine-3'- phosphorothioate
  modified_base 22: mod_base = OTHER; note = 2'-O-methyladenosine-3'- phosphorothioate
  modified_base 23: mod_base = OTHER; note = 2'-O-methyluridine-3'-phosphate
aaaatatgttgagtttttgaaat

SEQ ID NO: 401 - RNA, 23 nt, synthetic construct
  source 1..23: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-fluorocytidine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-fluorouridine-3'-phosphate
  modified_base 7: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-fluoroguanosine-3'-phosphate
  modified_base 15: mod_base = OTHER; note = 2'-O-methyluridine-3'-phosphate
  modified_base 16: mod_base = OTHER; note = 2'-fluorouridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyladenosine-3'- phosphorothioate
  modified_base 22: mod_base = OTHER; note = 2'-O-methyladenosine-3'- phosphorothioate
  modified_base 23: mod_base = OTHER; note = 2'-O-methyladenosine-3'-phosphate
acaaatatgttgagtttttgaaa

SEQ ID NO: 402 - RNA, 23 nt, synthetic construct
  source 1..23: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-fluorouridine -3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-fluoroadenosine-3'-phosphate
  modified_base 7: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-fluoroadenosine-3'-phosphate
  modified_base 15: mod_base = OTHER; note = 2'-O-methylguanosine-3'-phosphate
  modified_base 16: mod_base = OTHER; note = 2'-fluorouridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylguanosine-3'- phosphorothioate
  modified_base 22: mod_base = OTHER; note = 2'-O-methyladenosine-3'- phosphorothioate
  modified_base 23: mod_base = OTHER; note = 2'-O-methyladenosine-3'-phosphate
atcaaatatgttgagtttttgaa

SEQ ID NO: 403 - RNA, 23 nt, synthetic construct
  source 1..23: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-fluoroadenosine-3'-phosphate
  modified_base 7: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-fluoroguanosine-3'-phosphate
  modified_base 15: mod_base = OTHER; note = 2'-O-methyladenosine-3'-phosphate
  modified_base 16: mod_base = OTHER; note = 2'-fluoroguanosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  modified_base 23: mod_base = OTHER; note = 2'-O-methyladenosine-3'-phosphate
aatcaaatatgttgagtttttga

SEQ ID NO: 404 - RNA, 23 nt, synthetic construct
  source 1..23: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-fluoroadenosine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-fluoroadenosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
agatcaaatatgttgagtttttg

SEQ ID NO: 405 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-fluorouridine -3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = Adenosine-glycol nucleic acid (GNA) S-Isomer
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-fluoroguanosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
  misc_feature 1..4: note = RNA
  misc_feature 5: note = DNA
  misc_feature 6..23: note = RNA
atgatcaaatatgttgagttttt

SEQ ID NO: 406 - RNA, 23 nt, synthetic construct
  source 1..23: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-fluorocytidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-fluorouridine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-fluoroguanosine-3'-phosphate
  modified_base 15: mod_base = OTHER; note = 2'-O-methyluridine-3'-phosphate
  modified_base 16: mod_base = OTHER; note = 2'-fluorouridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
actgatcaaatatgttgagtttt

SEQ ID NO: 407 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = Thymidine-glycol nucleic acid (GNA) S-Isomer
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-fluorouridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
  misc_feature 1..4: note = RNA
  misc_feature 5: note = DNA
  misc_feature 6..23: note = RNA
aactgatcaaatatgttgagttt

SEQ ID NO: 408 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = guanosine-2'-phosphate
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-fluorouridine-3'-phosphate
  modified_base 15: mod_base = OTHER; note = 2'-O-methyladenosine-3'-phosphate
  modified_base 16: mod_base = OTHER; note = 2'-fluorouridine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyladenosine-3'- phosphorothioate
  modified_base 22: mod_base = OTHER; note = 2'-O-methylguanosine-3'- phosphorothioate
  modified_base 23: mod_base = OTHER; note = 2'-O-methyluridine-3'-phosphate
  misc_feature 1..4: note = RNA
  misc_feature 5: note = DNA
  misc_feature 6..23: note = RNA
aagactgatcaaatatgttgagt

SEQ ID NO: 409 - RNA, 23 nt, synthetic construct
  source 1..23: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-fluorocytidine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-fluoroadenosine-3'-phosphate
  modified_base 15: mod_base = OTHER; note = 2'-O-methyluridine-3'-phosphate
  modified_base 16: mod_base = OTHER; note = 2'-fluoroadenosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylguanosine-3'- phosphorothioate
  modified_base 22: mod_base = OTHER; note = 2'-O-methyladenosine-3'- phosphorothioate
  modified_base 23: mod_base = OTHER; note = 2'-O-methylguanosine-3'-phosphate
aaagactgatcaaatatgttgag

SEQ ID NO: 410 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = cytidine-2'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-fluoroadenosine-3'-phosphate
  modified_base 15: mod_base = OTHER; note = 2'-O-methyladenosine-3'-phosphate
  modified_base 16: mod_base = OTHER; note = 2'-fluorouridine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  modified_base 23: mod_base = OTHER; note = 2'-O-methyladenosine-3'-phosphate
  misc_feature 1..4: note = RNA
  misc_feature 5: note = DNA
  misc_feature 6..23: note = RNA
aaaagactgatcaaatatgttga

SEQ ID NO: 411 - RNA, 23 nt, synthetic construct
  source 1..23: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-fluoroguanosine-3'-phosphate
  modified_base 7: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methyladenosine-3'-phosphate
  modified_base 16: mod_base = OTHER; note = 2'-fluoroadenosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
aaaaagactgatcaaatatgttg

SEQ ID NO: 412 - RNA, 23 nt, synthetic construct
  source 1..23: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-fluoroadenosine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-fluoroadenosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methylguanosine-3'- phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
aaaaaagactgatcaaatatgtt

SEQ ID NO: 413 - RNA, 23 nt, synthetic construct
  source 1..23: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-fluorouridine -3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-fluoroadenosine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-fluoroadenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  modified_base 23: mod_base = OTHER; note = 2'-O-methyluridine-3'-phosphate
ataaaaagactgatcaaatatgt

SEQ ID NO: 414 - RNA, 23 nt, synthetic construct
  source 1..23: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-fluoroadenosine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-fluoroadenosine-3'-phosphate
  modified_base 15: mod_base = OTHER; note = 2'-O-methyluridine-3'-phosphate
  modified_base 16: mod_base = OTHER; note = 2'-fluorocytidine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyladenosine-3'- phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
aataaaaagactgatcaaatatg

SEQ ID NO: 415 - RNA, 23 nt, synthetic construct
  source 1..23: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-fluorocytidine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-fluoroadenosine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-fluoroguanosine-3'-phosphate
  modified_base 15: mod_base = OTHER; note = 2'-O-methyladenosine-3'-phosphate
  modified_base 16: mod_base = OTHER; note = 2'-fluorouridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methyladenosine-3'- phosphorothioate
  modified_base 23: mod_base = OTHER; note = 2'-O-methyluridine-3'-phosphate
acataaaaagactgatcaaatat

SEQ ID NO: 416 - RNA, 23 nt, synthetic construct
  source 1..23: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-fluorouridine -3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-fluoroadenosine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-fluoroadenosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyladenosine-3'- phosphorothioate
  modified_base 22: mod_base = OTHER; note = 2'-O-methyluridine-3'-phosphorothioate
  modified_base 23: mod_base = OTHER; note = 2'-O-methyladenosine-3'-phosphate
atcataaaaagactgatcaaata

SEQ ID NO: 417 - RNA, 23 nt, synthetic construct
  source 1..23: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-fluorouridine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-fluorocytidine-3'-phosphate
  modified_base 15: mod_base = OTHER; note = 2'-O-methyluridine-3'-phosphate
  modified_base 16: mod_base = OTHER; note = 2'-fluoroguanosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyladenosine-3'- phosphorothioate
  modified_base 22: mod_base = OTHER; note = 2'-O-methyladenosine-3'- phosphorothioate
  modified_base 23: mod_base = OTHER; note = 2'-O-methyluridine-3'-phosphate
aatcataaaaagactgatcaaat

SEQ ID NO: 418 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = Thymidine-glycol nucleic acid (GNA) S-Isomer
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-fluoroadenosine-3'-phosphate
  modified_base 15: mod_base = OTHER; note = 2'-O-methylcytidine-3'-phosphate
  modified_base 16: mod_base = OTHER; note = 2'-fluorouridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyladenosine-3'- phosphorothioate
  modified_base 22: mod_base = OTHER; note = 2'-O-methyladenosine-3'- phosphorothioate
  modified_base 23: mod_base = OTHER; note = 2'-O-methyladenosine-3'-phosphate
  misc_feature 1..4: note = RNA
  misc_feature 5: note = DNA
  misc_feature 6..23: note = RNA
agatcataaaaagactgatcaaa

SEQ ID NO: 419 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyluridine-3'-phosphorothioate
  modified_base 2: mod_base = OTHER; note = 2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = Adenosine-glycol nucleic acid (GNA) S-Isomer
  modified_base 8: mod_base = OTHER; note = 2'-O-methyluridine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-fluoroguanosine-3'-phosphate
  modified_base 15: mod_base = OTHER; note = 2'-O-methyladenosine-3'-phosphate
  modified_base 16: mod_base = OTHER; note = 2'-fluorocytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methylcytidine-3'- phosphorothioate
  modified_base 22: mod_base = OTHER; note = 2'-O-methyladenosine-3'- phosphorothioate
  modified_base 23: mod_base = OTHER; note = 2'-O-methyladenosine-3'-phosphate
  misc_feature 1..4: note = RNA
  misc_feature 5: note = DNA
  misc_feature 6..23: note = RNA
tagatcataaaaagactgatcaa

SEQ ID NO: 420 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-fluorouridine -3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = cytidine-2'-phosphate
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-fluoroadenosine-3'-phosphate
  modified_base 15: mod_base = OTHER; note = 2'-O-methylguanosine-3'-phosphate
  modified_base 16: mod_base = OTHER; note = 2'-fluoroadenosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  modified_base 23: mod_base = OTHER; note = 2'-O-methyladenosine-3'-phosphate
  misc_feature 1..4: note = RNA
  misc_feature 5: note = DNA
  misc_feature 6..23: note = RNA
atagatcataaaaagactgatca

SEQ ID NO: 421 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = Thymidine-glycol nucleic acid (GNA) S-Isomer
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-fluoroadenosine-3'-phosphate
  modified_base 15: mod_base = OTHER; note = 2'-O-methyladenosine-3'-phosphate
  modified_base 16: mod_base = OTHER; note = 2'-fluoroguanosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyladenosine-3'- phosphorothioate
  modified_base 22: mod_base = OTHER; note = 2'-O-methyluridine-3'-phosphorothioate
  modified_base 23: mod_base = OTHER; note = 2'-O-methylcytidine-3'-phosphate
  misc_feature 1..4: note = RNA
  misc_feature 5: note = DNA
  misc_feature 6..23: note = RNA
aatagatcataaaaagactgatc

SEQ ID NO: 422 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = Adenosine-glycol nucleic acid (GNA) S-Isomer
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-fluoroadenosine-3'-phosphate
  modified_base 15: mod_base = OTHER; note = 2'-O-methyladenosine-3'-phosphate
  modified_base 16: mod_base = OTHER; note = 2'-fluoroadenosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylguanosine-3'- phosphorothioate
  modified_base 22: mod_base = OTHER; note = 2'-O-methyladenosine-3'- phosphorothioate
  modified_base 23: mod_base = OTHER; note = 2'-O-methyluridine-3'-phosphate
  misc_feature 1..4: note = RNA
  misc_feature 5: note = DNA
  misc_feature 6..23: note = RNA
agatagatcataaaaagactgat

SEQ ID NO: 423 - RNA, 23 nt, synthetic construct
  source 1..23: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-fluorocytidine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-fluoroadenosine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-fluoroadenosine-3'-phosphate
  modified_base 15: mod_base = OTHER; note = 2'-O-methyladenosine-3'-phosphate
  modified_base 16: mod_base = OTHER; note = 2'-fluoroadenosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  modified_base 23: mod_base = OTHER; note = 2'-O-methyladenosine-3'-phosphate
acgatagatcataaaaagactga

SEQ ID NO: 424 - RNA, 23 nt, synthetic construct
  source 1..23: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-fluorouridine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-fluoroadenosine-3'-phosphate
  modified_base 15: mod_base = OTHER; note = 2'-O-methyladenosine-3'-phosphate
  modified_base 16: mod_base = OTHER; note = 2'-fluoroadenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methylcytidine-3'- phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
agcgatagatcataaaaagactg

SEQ ID NO: 425 - RNA, 23 nt, synthetic construct
  source 1..23: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methylguanosine-3'-phosphate
  modified_base 6: mod_base = OTHER; note = 2'-fluoroadenosine-3'-phosphate
  modified_base 7: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-fluorouridine-3'-phosphate
  modified_base 15: mod_base = OTHER; note = 2'-O-methyladenosine-3'-phosphate
  modified_base 16: mod_base = OTHER; note = 2'-fluoroadenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyladenosine-3'- phosphorothioate
  modified_base 22: mod_base = OTHER; note = 2'-O-methylcytidine-3'- phosphorothioate
  modified_base 23: mod_base = OTHER; note = 2'-O-methyluridine-3'-phosphate
aagcgatagatcataaaaagact

SEQ ID NO: 426 - RNA, 23 nt, synthetic construct
  source 1..23: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-fluorocytidine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-fluoroguanosine-3'-phosphate
  modified_base 7: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methyluridine-3'-phosphate
  modified_base 16: mod_base = OTHER; note = 2'-fluoroadenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methylguanosine-3'- phosphorothioate
  modified_base 22: mod_base = OTHER; note = 2'-O-methyladenosine-3'- phosphorothioate
  modified_base 23: mod_base = OTHER; note = 2'-O-methylcytidine-3'-phosphate
acagcgatagatcataaaaagac

SEQ ID NO: 427 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-fluorocytidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = guanosine-2'-phosphate
  modified_base 8: mod_base = OTHER; note = 2'-O-methylguanosine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methyluridine-3'-phosphate
  modified_base 16: mod_base = OTHER; note = 2'-fluoroguanosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylcytidine-3'-phosphate
  misc_feature 1..4: note = RNA
  misc_feature 5: note = DNA
  misc_feature 6..23: note = RNA
acttctgggtgttctggagtttc

SEQ ID NO: 428 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyluridine-3'-phosphorothioate
  modified_base 2: mod_base = OTHER; note = 2'-fluoroadenosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = Thymidine-glycol nucleic acid (GNA) S-Isomer
  modified_base 8: mod_base = OTHER; note = 2'-O-methylguanosine-3'-phosphate
  modified_base 9: mod_base = OTHER; note = 2'-O-methylguanosine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-fluorouridine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
  misc_feature 1..4: note = RNA
  misc_feature 5: note = DNA
  misc_feature 6..23: note = RNA
tacttctgggtgttctggagttt

SEQ ID NO: 429 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyluridine-3'-phosphorothioate
  modified_base 2: mod_base = OTHER; note = 2'-fluorouridine -3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = cytidine-2'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methylguanosine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-fluorocytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methylguanosine-3'- phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
  misc_feature 1..4: note = RNA
  misc_feature 5: note = DNA
  misc_feature 6..23: note = RNA
ttacttctgggtgttctggagtt

SEQ ID NO: 430 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-fluorouridine -3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = Thymidine-glycol nucleic acid (GNA) S-Isomer
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-fluoroguanosine-3'-phosphate
  modified_base 15: mod_base = OTHER; note = 2'-O-methyluridine-3'-phosphate
  modified_base 16: mod_base = OTHER; note = 2'-fluorouridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyladenosine-3'- phosphorothioate
  modified_base 22: mod_base = OTHER; note = 2'-O-methylguanosine-3'- phosphorothioate
  modified_base 23: mod_base = OTHER; note = 2'-O-methyluridine-3'-phosphate
  misc_feature 1..4: note = RNA
  misc_feature 5: note = DNA
  misc_feature 6..23: note = RNA
attacttctgggtgttctggagt

SEQ ID NO: 431 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = Thymidine-glycol nucleic acid (GNA) S-Isomer
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-fluorouridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methylguanosine-3'- phosphorothioate
  modified_base 22: mod_base = OTHER; note = 2'-O-methyladenosine-3'- phosphorothioate
  modified_base 23: mod_base = OTHER; note = 2'-O-methylguanosine-3'-phosphate
  misc_feature 1..4: note = RNA
  misc_feature 5: note = DNA
  misc_feature 6..23: note = RNA
agttacttctgggtgttctggag

SEQ ID NO: 432 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = cytidine-2'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-fluoroguanosine-3'-phosphate
  modified_base 15: mod_base = OTHER; note = 2'-O-methyluridine-3'-phosphate
  modified_base 16: mod_base = OTHER; note = 2'-fluoroguanosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylguanosine-3'- phosphorothioate
  modified_base 22: mod_base = OTHER; note = 2'-O-methylguanosine-3'- phosphorothioate
  modified_base 23: mod_base = OTHER; note = 2'-O-methyladenosine-3'-phosphate
  misc_feature 1..4: note = RNA
  misc_feature 5: note = DNA
  misc_feature 6..23: note = RNA
aagttacttctgggtgttctgga

SEQ ID NO: 433 - RNA, 23 nt, synthetic construct
  source 1..23: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-fluorouridine-3'-phosphate
  modified_base 7: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-fluoroguanosine-3'-phosphate
  modified_base 15: mod_base = OTHER; note = 2'-O-methylguanosine-3'-phosphate
  modified_base 16: mod_base = OTHER; note = 2'-fluorouridine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  modified_base 23: mod_base = OTHER; note = 2'-O-methylguanosine-3'-phosphate
aaagttacttctgggtgttctgg

SEQ ID NO: 434 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyluridine-3'-phosphorothioate
  modified_base 2: mod_base = OTHER; note = 2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = Thymidine-glycol nucleic acid (GNA) S-Isomer
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-fluoroguanosine-3'-phosphate
  modified_base 15: mod_base = OTHER; note = 2'-O-methylguanosine-3'-phosphate
  modified_base 16: mod_base = OTHER; note = 2'-fluoroguanosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylcytidine-3'- phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
  misc_feature 1..4: note = RNA
  misc_feature 5: note = DNA
  misc_feature 6..23: note = RNA
tgaagttacttctgggtgttctg

SEQ ID NO: 435 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-fluorouridine -3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = Thymidine-glycol nucleic acid (GNA) S-Isomer
  modified_base 8: mod_base = OTHER; note = 2'-O-methyluridine-3'-phosphate
  modified_base 9: mod_base = OTHER; note = 2'-O-methyladenosine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-fluoroguanosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  modified_base 23: mod_base = OTHER; note = 2'-O-methyluridine-3'-phosphate
  misc_feature 1..4: note = RNA
  misc_feature 5: note = DNA
  misc_feature 6..23: note = RNA
atgaagttacttctgggtgttct

SEQ ID NO: 436 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = guanosine-2'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methyluridine-3'-phosphate
  modified_base 16: mod_base = OTHER; note = 2'-fluoroguanosine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylcytidine-3'-phosphate
  misc_feature 1..4: note = RNA
  misc_feature 5: note = DNA
  misc_feature 6..23: note = RNA
agtgaagttacttctgggtgttc

SEQ ID NO: 437 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = Adenosine-glycol nucleic acid (GNA) S-Isomer
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-fluorouridine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methylguanosine-3'- phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
  misc_feature 1..4: note = RNA
  misc_feature 5: note = DNA
  misc_feature 6..23: note = RNA
aagtgaagttacttctgggtgtt

SEQ ID NO: 438 - RNA, 23 nt, synthetic construct
  source 1..23: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-fluoroguanosine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-fluorocytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  modified_base 23: mod_base = OTHER; note = 2'-O-methyluridine-3'-phosphate
aaagtgaagttacttctgggtgt

SEQ ID NO: 439 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyluridine-3'-phosphorothioate
  modified_base 2: mod_base = OTHER; note = 2'-fluorouridine -3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = guanosine-2'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-fluorocytidine-3'-phosphate
  modified_base 15: mod_base = OTHER; note = 2'-O-methyluridine-3'-phosphate
  modified_base 16: mod_base = OTHER; note = 2'-fluorouridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methylguanosine-3'- phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
  misc_feature 1..4: note = RNA
  misc_feature 5: note = DNA
  misc_feature 6..23: note = RNA
ttaagtgaagttacttctgggtg

SEQ ID NO: 440 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyluridine-3'-phosphorothioate
  modified_base 2: mod_base = OTHER; note = 2'-fluorouridine -3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = Thymidine-glycol nucleic acid (GNA) S-Isomer
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-fluoroadenosine-3'-phosphate
  modified_base 15: mod_base = OTHER; note = 2'-O-methylcytidine-3'-phosphate
  modified_base 16: mod_base = OTHER; note = 2'-fluorouridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methylguanosine-3'- phosphorothioate
  modified_base 22: mod_base = OTHER; note = 2'-O-methylguanosine-3'- phosphorothioate
  modified_base 23: mod_base = OTHER; note = 2'-O-methyluridine-3'-phosphate
  misc_feature 1..4: note = RNA
  misc_feature 5: note = DNA
  misc_feature 6..23: note = RNA
tttaagtgaagttacttctgggt

SEQ ID NO: 441 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyluridine-3'-phosphorothioate
  modified_base 2: mod_base = OTHER; note = 2'-fluorouridine -3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = guanosine-2'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methyladenosine-3'-phosphate
  modified_base 16: mod_base = OTHER; note = 2'-fluorocytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylguanosine-3'- phosphorothioate
  modified_base 22: mod_base = OTHER; note = 2'-O-methylguanosine-3'- phosphorothioate
  modified_base 23: mod_base = OTHER; note = 2'-O-methylguanosine-3'-phosphate
  misc_feature 1..4: note = RNA
  misc_feature 5: note = DNA
  misc_feature 6..23: note = RNA
ttttaagtgaagttacttctggg

SEQ ID NO: 442 - RNA, 23 nt, synthetic construct
  source 1..23: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-fluorouridine -3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-fluoroadenosine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-fluoroadenosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  modified_base 23: mod_base = OTHER; note = 2'-O-methylguanosine-3'-phosphate
attttaagtgaagttacttctgg

SEQ ID NO: 443 - RNA, 23 nt, synthetic construct
  source 1..23: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-fluorouridine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-fluoroguanosine-3'-phosphate
  modified_base 15: mod_base = OTHER; note = 2'-O-methyluridine-3'-phosphate
  modified_base 16: mod_base = OTHER; note = 2'-fluorouridine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylcytidine-3'- phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
agttttaagtgaagttacttctg

SEQ ID NO: 444 - RNA, 23 nt, synthetic construct
  source 1..23: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-fluorouridine-3'-phosphate
  modified_base 7: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-fluoroadenosine-3'-phosphate
  modified_base 15: mod_base = OTHER; note = 2'-O-methylguanosine-3'-phosphate
  modified_base 16: mod_base = OTHER; note = 2'-fluorouridine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  modified_base 23: mod_base = OTHER; note = 2'-O-methyluridine-3'-phosphate
aagttttaagtgaagttacttct

SEQ ID NO: 445 - RNA, 23 nt, synthetic construct
  source 1..23: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-fluorouridine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-fluoroadenosine-3'-phosphate
  modified_base 15: mod_base = OTHER; note = 2'-O-methyladenosine-3'-phosphate
  modified_base 16: mod_base = OTHER; note = 2'-fluoroguanosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylcytidine-3'-phosphate
aaagttttaagtgaagttacttc

SEQ ID NO: 446 - RNA, 23 nt, synthetic construct
  source 1..23: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-fluorouridine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-fluoroguanosine-3'-phosphate
  modified_base 15: mod_base = OTHER; note = 2'-O-methyladenosine-3'-phosphate
  modified_base 16: mod_base = OTHER; note = 2'-fluoroadenosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methylcytidine-3'- phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
aaaagttttaagtgaagttactt

SEQ ID NO: 447 - RNA, 23 nt, synthetic construct
  source 1..23: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-fluoroguanosine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-fluoroadenosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyladenosine-3'- phosphorothioate
  modified_base 22: mod_base = OTHER; note = 2'-O-methylcytidine-3'- phosphorothioate
  modified_base 23: mod_base = OTHER; note = 2'-O-methyluridine-3'-phosphate
aaaaagttttaagtgaagttact

SEQ ID NO: 448 - RNA, 23 nt, synthetic construct
  source 1..23: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-fluorocytidine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-fluoroadenosine-3'-phosphate
  modified_base 7: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-fluoroguanosine-3'-phosphate
  modified_base 15: mod_base = OTHER; note = 2'-O-methyluridine-3'-phosphate
  modified_base 16: mod_base = OTHER; note = 2'-fluoroguanosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methyladenosine-3'- phosphorothioate
  modified_base 23: mod_base = OTHER; note = 2'-O-methylcytidine-3'-phosphate
acaaaagttttaagtgaagttac

SEQ ID NO: 449 - RNA, 23 nt, synthetic construct
  source 1..23: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-fluoroadenosine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-fluoroadenosine-3'-phosphate
  modified_base 15: mod_base = OTHER; note = 2'-O-methylguanosine-3'-phosphate
  modified_base 16: mod_base = OTHER; note = 2'-fluorouridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyladenosine-3'-phosphate
aacaaaagttttaagtgaagtta

SEQ ID NO: 450 - RNA, 23 nt, synthetic construct
  source 1..23: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-fluorouridine -3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-fluoroadenosine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-fluoroadenosine-3'-phosphate
  modified_base 15: mod_base = OTHER; note = 2'-O-methyladenosine-3'-phosphate
  modified_base 16: mod_base = OTHER; note = 2'-fluoroguanosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methylguanosine-3'- phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
atacaaaagttttaagtgaagtt

SEQ ID NO: 451 - RNA, 23 nt, synthetic construct
  source 1..23: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-fluorocytidine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-fluoroadenosine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methyladenosine-3'-phosphate
  modified_base 16: mod_base = OTHER; note = 2'-fluoroadenosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyladenosine-3'- phosphorothioate
  modified_base 22: mod_base = OTHER; note = 2'-O-methylguanosine-3'- phosphorothioate
  modified_base 23: mod_base = OTHER; note = 2'-O-methyluridine-3'-phosphate
actacaaaagttttaagtgaagt

SEQ ID NO: 452 - RNA, 23 nt, synthetic construct
  source 1..23: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-fluorouridine -3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-fluorocytidine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-fluoroadenosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyladenosine-3'- phosphorothioate
  modified_base 22: mod_base = OTHER; note = 2'-O-methyladenosine-3'- phosphorothioate
  modified_base 23: mod_base = OTHER; note = 2'-O-methylguanosine-3'-phosphate
atctacaaaagttttaagtgaag

SEQ ID NO: 453 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyluridine-3'-phosphorothioate
  modified_base 2: mod_base = OTHER; note = 2'-fluorouridine -3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = cytidine-2'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-fluorouridine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methylguanosine-3'- phosphorothioate
  modified_base 22: mod_base = OTHER; note = 2'-O-methyladenosine-3'- phosphorothioate
  modified_base 23: mod_base = OTHER; note = 2'-O-methyladenosine-3'-phosphate
  misc_feature 1..4: note = RNA
  misc_feature 5: note = DNA
  misc_feature 6..23: note = RNA
tttctacaaaagttttaagtgaa

SEQ ID NO: 454 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyluridine-3'-phosphorothioate
  modified_base 2: mod_base = OTHER; note = 2'-fluorouridine -3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = Adenosine-glycol nucleic acid (GNA) S-Isomer
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-fluorouridine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  modified_base 23: mod_base = OTHER; note = 2'-O-methyladenosine-3'-phosphate
  misc_feature 1..4: note = RNA
  misc_feature 5: note = DNA
  misc_feature 6..23: note = RNA
ttttctacaaaagttttaagtga

SEQ ID NO: 455 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-deoxyguanosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 6: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aggagcttaattgtgaacatttt

SEQ ID NO: 456 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-deoxycytidine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 6: mod_base = OTHER; note = 2'-O-methylguanosine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-fluorouridine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
acatcgtctaacatagcaaatct

SEQ ID NO: 457 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyluridine-3'-phosphorothioate
  modified_base 2: mod_base = OTHER; note = 2'-deoxythimidine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 6: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyladenosine-3'- phosphorothioate
  modified_base 22: mod_base = OTHER; note = 2'-O-methyladenosine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
ttacatcgtctaacatagcaaat

SEQ ID NO: 458 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyluridine-3'-phosphorothioate
  modified_base 2: mod_base = OTHER; note = 2'-deoxythimidine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-fluoroadenosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyladenosine-3'- phosphorothioate
  modified_base 22: mod_base = OTHER; note = 2'-O-methyladenosine-3'- phosphorothioate
  modified_base 23: mod_base = OTHER; note = 2'-O-methyladenosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
tttacatcgtctaacatagcaaa

SEQ ID NO: 459 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyluridine-3'-phosphorothioate
  modified_base 2: mod_base = OTHER; note = 2'-deoxyadenosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 6: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  modified_base 23: mod_base = OTHER; note = 2'-O-methylcytidine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
tatatgtagttcttctcagttcc

SEQ ID NO: 460 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyluridine-3'-phosphorothioate
  modified_base 2: mod_base = OTHER; note = 2'-deoxyadenosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methylguanosine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyladenosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
tatttgactatgctgttggttta

SEQ ID NO: 461 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-deoxyguanosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 6: mod_base = OTHER; note = 2'-O-methylguanosine-3'-phosphate
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methylguanosine-3'- phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
agatagagaaatttctgtgggtt

SEQ ID NO: 462 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyluridine-3'-phosphorothioate
  modified_base 2: mod_base = OTHER; note = 2'-deoxythimidine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 6: mod_base = OTHER; note = 2'-O-methylguanosine-3'-phosphate
  modified_base 8: mod_base = OTHER; note = 2'-O-methylcytidine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-fluoroadenosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylguanosine-3'- phosphorothioate
  modified_base 22: mod_base = OTHER; note = 2'-O-methyladenosine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
ttaatgtccatggactacctgat

SEQ ID NO: 463 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-fluoroguanosine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methylcytidine-3'- phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aattaatgtccatggactacctg

SEQ ID NO: 464 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyluridine-3'-phosphorothioate
  modified_base 2: mod_base = OTHER; note = 2'-deoxyguanosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 6: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  modified_base 23: mod_base = OTHER; note = 2'-O-methyladenosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
tgtctttccagtcttccaactca

SEQ ID NO: 465 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-deoxythimidine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 6: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyladenosine-3'- phosphorothioate
  modified_base 22: mod_base = OTHER; note = 2'-O-methylguanosine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
ataatgtttgttgtctttccagt

SEQ ID NO: 466 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyluridine-3'-phosphorothioate
  modified_base 2: mod_base = OTHER; note = 2'-deoxythimidine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 6: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyladenosine-3'- phosphorothioate
  modified_base 22: mod_base = OTHER; note = 2'-O-methyladenosine-3'- phosphorothioate
  modified_base 23: mod_base = OTHER; note = 2'-O-methyladenosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
tttcgtgatttcccaagtaaaaa

SEQ ID NO: 467 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyluridine-3'-phosphorothioate
  modified_base 2: mod_base = OTHER; note = 2'-deoxyadenosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 6: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-fluoroguanosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methylcytidine-3'- phosphorothioate
  modified_base 22: mod_base = OTHER; note = 2'-O-methyladenosine-3'- phosphorothioate
  modified_base 23: mod_base = OTHER; note = 2'-O-methyladenosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
tagttggtttcgtgatttcccaa

SEQ ID NO: 468 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyluridine-3'-phosphorothioate
  modified_base 2: mod_base = OTHER; note = 2'-deoxyadenosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 6: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluoroguanosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylcytidine-3'- phosphorothioate
  modified_base 22: mod_base = OTHER; note = 2'-O-methylcytidine-3'- phosphorothioate
  modified_base 23: mod_base = OTHER; note = 2'-O-methylcytidine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
tatagttggtttcgtgatttccc

SEQ ID NO: 469 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyluridine-3'-phosphorothioate
  modified_base 2: mod_base = OTHER; note = 2'-deoxyguanosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 6: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methylguanosine-3'- phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
tgtagcgtatagttggtttcgtg

SEQ ID NO: 470 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyluridine-3'-phosphorothioate
  modified_base 2: mod_base = OTHER; note = 2'-deoxyguanosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 6: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
tggatcaacattttggttgattt

SEQ ID NO: 471 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyluridine-3'-phosphorothioate
  modified_base 2: mod_base = OTHER; note = 2'-deoxyadenosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-fluoroadenosine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyladenosine-3'- phosphorothioate
  modified_base 22: mod_base = OTHER; note = 2'-O-methylcytidine-3'- phosphorothioate
  modified_base 23: mod_base = OTHER; note = 2'-O-methyladenosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
tagtcaagttttgagttttaaca

SEQ ID NO: 472 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-deoxythimidine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 6: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylguanosine-3'- phosphorothioate
  modified_base 22: mod_base = OTHER; note = 2'-O-methyladenosine-3'- phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
ataggaggctttcaagttttgag

SEQ ID NO: 473 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 6: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluoroguanosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyladenosine-3'- phosphorothioate
  modified_base 22: mod_base = OTHER; note = 2'-O-methyladenosine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aatccatctattcgatgttgaat

SEQ ID NO: 474 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-deoxycytidine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 6: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-fluoroadenosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylguanosine-3'- phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
acacgtttcattgaagttttgtg

SEQ ID NO: 475 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-deoxyguanosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
agtatagttggtttcgtgatttc

SEQ ID NO: 476 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 6: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methylcytidine-3'- phosphorothioate
  modified_base 22: mod_base = OTHER; note = 2'-O-methyladenosine-3'- phosphorothioate
  modified_base 23: mod_base = OTHER; note = 2'-O-methylcytidine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aaccatctaaaattgattcccac

SEQ ID NO: 477 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-deoxythimidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 6: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-fluoroadenosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylguanosine-3'- phosphorothioate
  modified_base 22: mod_base = OTHER; note = 2'-O-methylguanosine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
attggatggatcaacattttggt

SEQ ID NO: 478 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyluridine-3'-phosphorothioate
  modified_base 2: mod_base = OTHER; note = 2'-deoxycytidine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 6: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-fluoroadenosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyladenosine-3'- phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
tcgatgttgaattaatgtccatg

SEQ ID NO: 479 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-deoxyguanosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 6: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 13: mod_base = OTHER; note = 2'-O-methylguanosine-3'-phosphate
  modified_base 15: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13: note = RNA
  misc_feature 14: note = DNA
  misc_feature 15: note = RNA
  misc_feature 16: note = DNA
  misc_feature 17..23: note = RNA
aggagcttaattgtgaacatttt

SEQ ID NO: 480 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-deoxycytidine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 6: mod_base = OTHER; note = 2'-O-methylguanosine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 13: mod_base = OTHER; note = 2'-O-methyladenosine-3'-phosphate
  modified_base 15: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13: note = RNA
  misc_feature 14: note = DNA
  misc_feature 15: note = RNA
  misc_feature 16: note = DNA
  misc_feature 17..23: note = RNA
acatcgtctaacatagcaaatct

SEQ ID NO: 481 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyluridine-3'-phosphorothioate
  modified_base 2: mod_base = OTHER; note = 2'-deoxythimidine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 6: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 13: mod_base = OTHER; note = 2'-O-methyladenosine-3'-phosphate
  modified_base 15: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyladenosine-3'- phosphorothioate
  modified_base 22: mod_base = OTHER; note = 2'-O-methyladenosine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13: note = RNA
  misc_feature 14: note = DNA
  misc_feature 15: note = RNA
  misc_feature 16: note = DNA
  misc_feature 17..23: note = RNA
ttacatcgtctaacatagcaaat

SEQ ID NO: 482 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyluridine-3'-phosphorothioate
  modified_base 2: mod_base = OTHER; note = 2'-deoxythimidine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 13: mod_base = OTHER; note = 2'-O-methyladenosine-3'-phosphate
  modified_base 15: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyladenosine-3'- phosphorothioate
  modified_base 22: mod_base = OTHER; note = 2'-O-methyladenosine-3'- phosphorothioate
  modified_base 23: mod_base = OTHER; note = 2'-O-methyladenosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13: note = RNA
  misc_feature 14: note = DNA
  misc_feature 15: note = RNA
  misc_feature 16: note = DNA
  misc_feature 17..23: note = RNA
tttacatcgtctaacatagcaaa

SEQ ID NO: 483 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyluridine-3'-phosphorothioate
  modified_base 2: mod_base = OTHER; note = 2'-deoxyadenosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 6: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 13: mod_base = OTHER; note = 2'-O-methyluridine-3'-phosphate
  modified_base 15: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  modified_base 23: mod_base = OTHER; note = 2'-O-methylcytidine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13: note = RNA
  misc_feature 14: note = DNA
  misc_feature 15: note = RNA
  misc_feature 16: note = DNA
  misc_feature 17..23: note = RNA
tatatgtagttcttctcagttcc

SEQ ID NO: 484 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyluridine-3'-phosphorothioate
  modified_base 2: mod_base = OTHER; note = 2'-deoxyadenosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methylguanosine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 13: mod_base = OTHER; note = 2'-O-methylcytidine-3'-phosphate
  modified_base 15: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyladenosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13: note = RNA
  misc_feature 14: note = DNA
  misc_feature 15: note = RNA
  misc_feature 16: note = DNA
  misc_feature 17..23: note = RNA
tatttgactatgctgttggttta

SEQ ID NO: 485 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-deoxyguanosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 6: mod_base = OTHER; note = 2'-O-methylguanosine-3'-phosphate
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 13: mod_base = OTHER; note = 2'-O-methyluridine-3'-phosphate
  modified_base 15: mod_base = OTHER; note = 2'-O-methylcytidine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methylguanosine-3'- phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13: note = RNA
  misc_feature 14: note = DNA
  misc_feature 15: note = RNA
  misc_feature 16: note = DNA
  misc_feature 17..23: note = RNA
agatagagaaatttctgtgggtt

SEQ ID NO: 486 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyluridine-3'-phosphorothioate
  modified_base 2: mod_base = OTHER; note = 2'-deoxythimidine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 6: mod_base = OTHER; note = 2'-O-methylguanosine-3'-phosphate
  modified_base 8: mod_base = OTHER; note = 2'-O-methylcytidine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 13: mod_base = OTHER; note = 2'-O-methylguanosine-3'-phosphate
  modified_base 15: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylguanosine-3'- phosphorothioate
  modified_base 22: mod_base = OTHER; note = 2'-O-methyladenosine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13: note = RNA
  misc_feature 14: note = DNA
  misc_feature 15: note = RNA
  misc_feature 16: note = DNA
  misc_feature 17..23: note = RNA
ttaatgtccatggactacctgat

SEQ ID NO: 487 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methylcytidine-3'-phosphate
  modified_base 13: mod_base = OTHER; note = 2'-O-methyluridine-3'-phosphate
  modified_base 15: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methylcytidine-3'- phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13: note = RNA
  misc_feature 14: note = DNA
  misc_feature 15: note = RNA
  misc_feature 16: note = DNA
  misc_feature 17..23: note = RNA
aattaatgtccatggactacctg

SEQ ID NO: 488 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyluridine-3'-phosphorothioate
  modified_base 2: mod_base = OTHER; note = 2'-deoxyguanosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 6: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 13: mod_base = OTHER; note = 2'-O-methylcytidine-3'-phosphate
  modified_base 15: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  modified_base 23: mod_base = OTHER; note = 2'-O-methyladenosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13: note = RNA
  misc_feature 14: note = DNA
  misc_feature 15: note = RNA
  misc_feature 16: note = DNA
  misc_feature 17..23: note = RNA
tgtctttccagtcttccaactca

SEQ ID NO: 489 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-deoxythimidine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 6: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 13: mod_base = OTHER; note = 2'-O-methylguanosine-3'-phosphate
  modified_base 15: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyladenosine-3'- phosphorothioate
  modified_base 22: mod_base = OTHER; note = 2'-O-methylguanosine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13: note = RNA
  misc_feature 14: note = DNA
  misc_feature 15: note = RNA
  misc_feature 16: note = DNA
  misc_feature 17..23: note = RNA
ataatgtttgttgtctttccagt

SEQ ID NO: 490 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyluridine-3'-phosphorothioate
  modified_base 2: mod_base = OTHER; note = 2'-deoxythimidine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 6: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 13: mod_base = OTHER; note = 2'-O-methylcytidine-3'-phosphate
  modified_base 15: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyladenosine-3'- phosphorothioate
  modified_base 22: mod_base = OTHER; note = 2'-O-methyladenosine-3'- phosphorothioate
  modified_base 23: mod_base = OTHER; note = 2'-O-methyladenosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13: note = RNA
  misc_feature 14: note = DNA
  misc_feature 15: note = RNA
  misc_feature 16: note = DNA
  misc_feature 17..23: note = RNA
tttcgtgatttcccaagtaaaaa

SEQ ID NO: 491 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyluridine-3'-phosphorothioate
  modified_base 2: mod_base = OTHER; note = 2'-deoxyadenosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 6: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 13: mod_base = OTHER; note = 2'-O-methyluridine-3'-phosphate
  modified_base 15: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methylcytidine-3'- phosphorothioate
  modified_base 22: mod_base = OTHER; note = 2'-O-methyladenosine-3'- phosphorothioate
  modified_base 23: mod_base = OTHER; note = 2'-O-methyladenosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13: note = RNA
  misc_feature 14: note = DNA
  misc_feature 15: note = RNA
  misc_feature 16: note = DNA
  misc_feature 17..23: note = RNA
tagttggtttcgtgatttcccaa

SEQ ID NO: 492 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyluridine-3'-phosphorothioate
  modified_base 2: mod_base = OTHER; note = 2'-deoxyadenosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 6: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 13: mod_base = OTHER; note = 2'-O-methylcytidine-3'-phosphate
  modified_base 15: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylcytidine-3'- phosphorothioate
  modified_base 22: mod_base = OTHER; note = 2'-O-methylcytidine-3'- phosphorothioate
  modified_base 23: mod_base = OTHER; note = 2'-O-methylcytidine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13: note = RNA
  misc_feature 14: note = DNA
  misc_feature 15: note = RNA
  misc_feature 16: note = DNA
  misc_feature 17..23: note = RNA
tatagttggtttcgtgatttccc

SEQ ID NO: 493 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyluridine-3'-phosphorothioate
  modified_base 2: mod_base = OTHER; note = 2'-deoxyguanosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 6: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 13: mod_base = OTHER; note = 2'-O-methyluridine-3'-phosphate
  modified_base 15: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methylguanosine-3'- phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13: note = RNA
  misc_feature 14: note = DNA
  misc_feature 15: note = RNA
  misc_feature 16: note = DNA
  misc_feature 17..23: note = RNA
tgtagcgtatagttggtttcgtg

SEQ ID NO: 494 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyluridine-3'-phosphorothioate
  modified_base 2: mod_base = OTHER; note = 2'-deoxyguanosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 6: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 13: mod_base = OTHER; note = 2'-O-methyluridine-3'-phosphate
  modified_base 15: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13: note = RNA
  misc_feature 14: note = DNA
  misc_feature 15: note = RNA
  misc_feature 16: note = DNA
  misc_feature 17..23: note = RNA
tggatcaacattttggttgattt

SEQ ID NO: 495 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyluridine-3'-phosphorothioate
  modified_base 2: mod_base = OTHER; note = 2'-deoxyadenosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 13: mod_base = OTHER; note = 2'-O-methylguanosine-3'-phosphate
  modified_base 15: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyladenosine-3'- phosphorothioate
  modified_base 22: mod_base = OTHER; note = 2'-O-methylcytidine-3'- phosphorothioate
  modified_base 23: mod_base = OTHER; note = 2'-O-methyladenosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13: note = RNA
  misc_feature 14: note = DNA
  misc_feature 15: note = RNA
  misc_feature 16: note = DNA
  misc_feature 17..23: note = RNA
tagtcaagttttgagttttaaca

SEQ ID NO: 496 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-deoxythimidine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 6: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 13: mod_base = OTHER; note = 2'-O-methylcytidine-3'-phosphate
  modified_base 15: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylguanosine-3'- phosphorothioate
  modified_base 22: mod_base = OTHER; note = 2'-O-methyladenosine-3'- phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13: note = RNA
  misc_feature 14: note = DNA
  misc_feature 15: note = RNA
  misc_feature 16: note = DNA
  misc_feature 17..23: note = RNA
ataggaggctttcaagttttgag

SEQ ID NO: 497 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 6: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 13: mod_base = OTHER; note = 2'-O-methylcytidine-3'-phosphate
  modified_base 15: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyladenosine-3'- phosphorothioate
  modified_base 22: mod_base = OTHER; note = 2'-O-methyladenosine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13: note = RNA
  misc_feature 14: note = DNA
  misc_feature 15: note = RNA
  misc_feature 16: note = DNA
  misc_feature 17..23: note = RNA
aatccatctattcgatgttgaat

SEQ ID NO: 498 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-deoxycytidine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 6: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 13: mod_base = OTHER; note = 2'-O-methylguanosine-3'-phosphate
  modified_base 15: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylguanosine-3'- phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13: note = RNA
  misc_feature 14: note = DNA
  misc_feature 15: note = RNA
  misc_feature 16: note = DNA
  misc_feature 17..23: note = RNA
acacgtttcattgaagttttgtg

SEQ ID NO: 499 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-deoxyguanosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methylguanosine-3'-phosphate
  modified_base 13: mod_base = OTHER; note = 2'-O-methyluridine-3'-phosphate
  modified_base 15: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13: note = RNA
  misc_feature 14: note = DNA
  misc_feature 15: note = RNA
  misc_feature 16: note = DNA
  misc_feature 17..23: note = RNA
agtatagttggtttcgtgatttc

SEQ ID NO: 500 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 6: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 13: mod_base = OTHER; note = 2'-O-methyluridine-3'-phosphate
  modified_base 15: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methylcytidine-3'- phosphorothioate
  modified_base 22: mod_base = OTHER; note = 2'-O-methyladenosine-3'- phosphorothioate
  modified_base 23: mod_base = OTHER; note = 2'-O-methylcytidine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13: note = RNA
  misc_feature 14: note = DNA
  misc_feature 15: note = RNA
  misc_feature 16: note = DNA
  misc_feature 17..23: note = RNA
aaccatctaaaattgattcccac

SEQ ID NO: 501 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-deoxythimidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 6: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 13: mod_base = OTHER; note = 2'-O-methyladenosine-3'-phosphate
  modified_base 15: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylguanosine-3'- phosphorothioate
  modified_base 22: mod_base = OTHER; note = 2'-O-methylguanosine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13: note = RNA
  misc_feature 14: note = DNA
  misc_feature 15: note = RNA
  misc_feature 16: note = DNA
  misc_feature 17..23: note = RNA
attggatggatcaacattttggt

SEQ ID NO: 502 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyluridine-3'-phosphorothioate
  modified_base 2: mod_base = OTHER; note = 2'-deoxycytidine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 6: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 13: mod_base = OTHER; note = 2'-O-methyluridine-3'-phosphate
  modified_base 15: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyladenosine-3'- phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13: note = RNA
  misc_feature 14: note = DNA
  misc_feature 15: note = RNA
  misc_feature 16: note = DNA
  misc_feature 17..23: note = RNA
tcgatgttgaattaatgtccatg

SEQ ID NO: 503 - RNA, 23 nt, Homo sapiens
  source 1..23: mol_type = genomic RNA
agataaaaatgttcacaattaag

SEQ ID NO: 504 - RNA, 23 nt, Homo sapiens
  source 1..23: mol_type = genomic RNA
gataaaaatgttcacaattaagc

SEQ ID NO: 505 - RNA, 23 nt, Homo sapiens
  source 1..23: mol_type = genomic RNA
ataaaaatgttcacaattaagct

SEQ ID NO: 506 - RNA, 23 nt, Homo sapiens
  source 1..23: mol_type = genomic RNA
taaaaatgttcacaattaagctc

SEQ ID NO: 507 - RNA, 23 nt, Homo sapiens
  source 1..23: mol_type = genomic RNA
aaaaatgttcacaattaagctcc

SEQ ID NO: 508 - RNA, 23 nt, Homo sapiens
  source 1..23: mol_type = genomic RNA
aaatgttcacaattaagctcctt

SEQ ID NO: 509 - RNA, 23 nt, Homo sapiens
  source 1..23: mol_type = genomic RNA
aatgttcacaattaagctccttc

SEQ ID NO: 510 - RNA, 23 nt, Homo sapiens
  source 1..23: mol_type = genomic RNA
atgttcacaattaagctccttct

SEQ ID NO: 511 - RNA, 23 nt, Homo sapiens
  source 1..23: mol_type = genomic RNA
tgttcacaattaagctccttctt

SEQ ID NO: 512 - RNA, 23 nt, Homo sapiens
  source 1..23: mol_type = genomic RNA
gttcacaattaagctccttcttt

SEQ ID NO: 513 - RNA, 23 nt, Homo sapiens
  source 1..23: mol_type = genomic RNA
ttcacaattaagctccttctttt

SEQ ID NO: 514 - RNA, 23 nt, Homo sapiens
  source 1..23: mol_type = genomic RNA
tcacaattaagctccttcttttt

SEQ ID NO: 515 - RNA, 23 nt, Homo sapiens
  source 1..23: mol_type = genomic RNA
cacaattaagctccttcttttta

SEQ ID NO: 516 - RNA, 23 nt, Homo sapiens
  source 1..23: mol_type = genomic RNA
acaattaagctccttctttttat

SEQ ID NO: 517 - RNA, 23 nt, Homo sapiens
  source 1..23: mol_type = genomic RNA
caattaagctccttctttttatt

SEQ ID NO: 518 - RNA, 23 nt, Homo sapiens
  source 1..23: mol_type = genomic RNA
aattaagctccttctttttattg

SEQ ID NO: 519 - RNA, 23 nt, Homo sapiens
  source 1..23: mol_type = genomic RNA
attaagctccttctttttattgt

SEQ ID NO: 520 - RNA, 23 nt, Homo sapiens
  source 1..23: mol_type = genomic RNA
ttaagctccttctttttattgtt

SEQ ID NO: 521 - RNA, 23 nt, Homo sapiens
  source 1..23: mol_type = genomic RNA
taagctccttctttttattgttc

SEQ ID NO: 522 - RNA, 23 nt, Homo sapiens
  source 1..23: mol_type = genomic RNA
aagctccttctttttattgttcc

SEQ ID NO: 523 - RNA, 23 nt, Homo sapiens
  source 1..23: mol_type = genomic RNA
agctccttctttttattgttcct

SEQ ID NO: 524 - RNA, 23 nt, Homo sapiens
  source 1..23: mol_type = genomic RNA
gctccttctttttattgttcctc

SEQ ID NO: 525 - RNA, 23 nt, Homo sapiens
  source 1..23: mol_type = genomic RNA
ctccttctttttattgttcctct

SEQ ID NO: 526 - RNA, 23 nt, Homo sapiens
  source 1..23: mol_type = genomic RNA
tccttctttttattgttcctcta

SEQ ID NO: 527 - RNA, 23 nt, Homo sapiens
  source 1..23: mol_type = genomic RNA
cttctttttattgttcctctagt

SEQ ID NO: 528 - RNA, 23 nt, Homo sapiens
  source 1..23: mol_type = genomic RNA
ttctttttattgttcctctagtt

SEQ ID NO: 529 - RNA, 23 nt, Homo sapiens
  source 1..23: mol_type = genomic RNA
tctttttattgttcctctagtta

SEQ ID NO: 530 - RNA, 23 nt, Homo sapiens
  source 1..23: mol_type = genomic RNA
ctttttattgttcctctagttat

SEQ ID NO: 531 - RNA, 23 nt, Homo sapiens
  source 1..23: mol_type = genomic RNA
atatttcaaaaactcaacatatt

SEQ ID NO: 532 - RNA, 23 nt, Homo sapiens
  source 1..23: mol_type = genomic RNA
tatttcaaaaactcaacatattt

SEQ ID NO: 533 - RNA, 23 nt, Homo sapiens
  source 1..23: mol_type = genomic RNA
atttcaaaaactcaacatatttg

SEQ ID NO: 534 - RNA, 23 nt, Homo sapiens
  source 1..23: mol_type = genomic RNA
tttcaaaaactcaacatatttga

SEQ ID NO: 535 - RNA, 23 nt, Homo sapiens
  source 1..23: mol_type = genomic RNA
ttcaaaaactcaacatatttgat

SEQ ID NO: 536 - RNA, 23 nt, Homo sapiens
  source 1..23: mol_type = genomic RNA
tcaaaaactcaacatatttgatc

SEQ ID NO: 537 - RNA, 23 nt, Homo sapiens
  source 1..23: mol_type = genomic RNA
caaaaactcaacatatttgatca

SEQ ID NO: 538 - RNA, 23 nt, Homo sapiens
  source 1..23: mol_type = genomic RNA
aaaaactcaacatatttgatcag

SEQ ID NO: 539 - RNA, 23 nt, Homo sapiens
  source 1..23: mol_type = genomic RNA
aaaactcaacatatttgatcagt

SEQ ID NO: 540 - RNA, 23 nt, Homo sapiens
  source 1..23: mol_type = genomic RNA
aaactcaacatatttgatcagtc

SEQ ID NO: 541 - RNA, 23 nt, Homo sapiens
  source 1..23: mol_type = genomic RNA
actcaacatatttgatcagtctt

SEQ ID NO: 542 - RNA, 23 nt, Homo sapiens
  source 1..23: mol_type = genomic RNA
ctcaacatatttgatcagtcttt

SEQ ID NO: 543 - RNA, 23 nt, Homo sapiens
  source 1..23: mol_type = genomic RNA
tcaacatatttgatcagtctttt

SEQ ID NO: 544 - RNA, 23 nt, Homo sapiens
  source 1..23: mol_type = genomic RNA
aaaaagactgatcaaatatgttg

SEQ ID NO: 545 - RNA, 23 nt, Homo sapiens
  source 1..23: mol_type = genomic RNA
aacatatttgatcagtcttttta

SEQ ID NO: 546 - RNA, 23 nt, Homo sapiens
  source 1..23: mol_type = genomic RNA
acatatttgatcagtctttttat

SEQ ID NO: 547 - RNA, 23 nt, Homo sapiens
  source 1..23: mol_type = genomic RNA
catatttgatcagtctttttatg

SEQ ID NO: 548 - RNA, 23 nt, Homo sapiens
  source 1..23: mol_type = genomic RNA
atatttgatcagtctttttatga

SEQ ID NO: 549 - RNA, 23 nt, Homo sapiens
  source 1..23: mol_type = genomic RNA
tatttgatcagtctttttatgat

SEQ ID NO: 550 - RNA, 23 nt, Homo sapiens
  source 1..23: mol_type = genomic RNA
atttgatcagtctttttatgatc

SEQ ID NO: 551 - RNA, 23 nt, Homo sapiens
  source 1..23: mol_type = genomic RNA
tttgatcagtctttttatgatct

SEQ ID NO: 552 - RNA, 23 nt, Homo sapiens
  source 1..23: mol_type = genomic RNA
ttgatcagtctttttatgatcta

SEQ ID NO: 553 - RNA, 23 nt, Homo sapiens
  source 1..23: mol_type = genomic RNA
tgatcagtctttttatgatctat

SEQ ID NO: 554 - RNA, 23 nt, Homo sapiens
  source 1..23: mol_type = genomic RNA
gatcagtctttttatgatctatc

SEQ ID NO: 555 - RNA, 23 nt, Homo sapiens
  source 1..23: mol_type = genomic RNA
atcagtctttttatgatctatcg

SEQ ID NO: 556 - RNA, 23 nt, Homo sapiens
  source 1..23: mol_type = genomic RNA
tcagtctttttatgatctatcgc

SEQ ID NO: 557 - RNA, 23 nt, Homo sapiens
  source 1..23: mol_type = genomic RNA
cagtctttttatgatctatcgct

SEQ ID NO: 558 - RNA, 23 nt, Homo sapiens
  source 1..23: mol_type = genomic RNA
agtctttttatgatctatcgctg

SEQ ID NO: 559 - RNA, 23 nt, Homo sapiens
  source 1..23: mol_type = genomic RNA
gtctttttatgatctatcgctgc

SEQ ID NO: 560 - RNA, 23 nt, Homo sapiens
  source 1..23: mol_type = genomic RNA
gaaactccagaacacccagaagt

SEQ ID NO: 561 - RNA, 23 nt, Homo sapiens
  source 1..23: mol_type = genomic RNA
aaactccagaacacccagaagta

SEQ ID NO: 562 - RNA, 23 nt, Homo sapiens
  source 1..23: mol_type = genomic RNA
aactccagaacacccagaagtaa

SEQ ID NO: 563 - RNA, 23 nt, Homo sapiens
  source 1..23: mol_type = genomic RNA
actccagaacacccagaagtaac

SEQ ID NO: 564 - RNA, 23 nt, Homo sapiens
  source 1..23: mol_type = genomic RNA
ctccagaacacccagaagtaact

SEQ ID NO: 565 - RNA, 23 nt, Homo sapiens
  source 1..23: mol_type = genomic RNA
tccagaacacccagaagtaactt

SEQ ID NO: 566 - RNA, 23 nt, Homo sapiens
  source 1..23: mol_type = genomic RNA
ccagaacacccagaagtaacttc

SEQ ID NO: 567 - RNA, 23 nt, Homo sapiens
  source 1..23: mol_type = genomic RNA
cagaacacccagaagtaacttca

SEQ ID NO: 568 - RNA, 23 nt, Homo sapiens
  source 1..23: mol_type = genomic RNA
agaacacccagaagtaacttcac

SEQ ID NO: 569 - RNA, 23 nt, Homo sapiens
  source 1..23: mol_type = genomic RNA
gaacacccagaagtaacttcact

SEQ ID NO: 570 - RNA, 23 nt, Homo sapiens
  source 1..23: mol_type = genomic RNA
aacacccagaagtaacttcactt

SEQ ID NO: 571 - RNA, 23 nt, Homo sapiens
  source 1..23: mol_type = genomic RNA
acacccagaagtaacttcactta

SEQ ID NO: 572 - RNA, 23 nt, Homo sapiens
  source 1..23: mol_type = genomic RNA
cacccagaagtaacttcacttaa

SEQ ID NO: 573 - RNA, 23 nt, Homo sapiens
  source 1..23: mol_type = genomic RNA
acccagaagtaacttcacttaaa

SEQ ID NO: 574 - RNA, 23 nt, Homo sapiens
  source 1..23: mol_type = genomic RNA
cccagaagtaacttcacttaaaa

SEQ ID NO: 575 - RNA, 23 nt, Homo sapiens
  source 1..23: mol_type = genomic RNA
ccagaagtaacttcacttaaaac

SEQ ID NO: 576 - RNA, 23 nt, Homo sapiens
  source 1..23: mol_type = genomic RNA
cagaagtaacttcacttaaaact

SEQ ID NO: 577 - RNA, 23 nt, Homo sapiens
  source 1..23: mol_type = genomic RNA
agaagtaacttcacttaaaactt

SEQ ID NO: 578 - RNA, 23 nt, Homo sapiens
  source 1..23: mol_type = genomic RNA
gaagtaacttcacttaaaacttt

SEQ ID NO: 579 - RNA, 23 nt, Homo sapiens
  source 1..23: mol_type = genomic RNA
aagtaacttcacttaaaactttt

SEQ ID NO: 580 - RNA, 23 nt, Homo sapiens
  source 1..23: mol_type = genomic RNA
agtaacttcacttaaaacttttg

SEQ ID NO: 581 - RNA, 23 nt, Homo sapiens
  source 1..23: mol_type = genomic RNA
gtaacttcacttaaaacttttgt

SEQ ID NO: 582 - RNA, 23 nt, Homo sapiens
  source 1..23: mol_type = genomic RNA
taacttcacttaaaacttttgta

SEQ ID NO: 583 - RNA, 23 nt, Homo sapiens
  source 1..23: mol_type = genomic RNA
aacttcacttaaaacttttgtag

SEQ ID NO: 584 - RNA, 23 nt, Homo sapiens
  source 1..23: mol_type = genomic RNA
acttcacttaaaacttttgtaga

SEQ ID NO: 585 - RNA, 23 nt, Homo sapiens
  source 1..23: mol_type = genomic RNA
cttcacttaaaacttttgtagaa

SEQ ID NO: 586 - RNA, 23 nt, Homo sapiens
  source 1..23: mol_type = genomic RNA
ttcacttaaaacttttgtagaaa

SEQ ID NO: 587 - RNA, 23 nt, Homo sapiens
  source 1..23: mol_type = genomic RNA
tcacttaaaacttttgtagaaaa

SEQ ID NO: 588 - RNA, 23 nt, Homo sapiens
  source 1..23: mol_type = genomic RNA
aaaatgttcacaattaagctcct

SEQ ID NO: 589 - RNA, 23 nt, Homo sapiens
  source 1..23: mol_type = genomic RNA
agatttgctatgttagacgatgt

SEQ ID NO: 590 - RNA, 23 nt, Homo sapiens
  source 1..23: mol_type = genomic RNA
atttgctatgttagacgatgtaa

SEQ ID NO: 591 - RNA, 23 nt, Homo sapiens
  source 1..23: mol_type = genomic RNA
tttgctatgttagacgatgtaaa

SEQ ID NO: 592 - RNA, 23 nt, Homo sapiens
  source 1..23: mol_type = genomic RNA
ggaactgagaagaactacatata

SEQ ID NO: 593 - RNA, 23 nt, Homo sapiens
  source 1..23: mol_type = genomic RNA
taaaccaacagcatagtcaaata

SEQ ID NO: 594 - RNA, 23 nt, Homo sapiens
  source 1..23: mol_type = genomic RNA
aacccacagaaatttctctatct

SEQ ID NO: 595 - RNA, 23 nt, Homo sapiens
  source 1..23: mol_type = genomic RNA
atcaggtagtccatggacattaa

SEQ ID NO: 596 - RNA, 23 nt, Homo sapiens
  source 1..23: mol_type = genomic RNA
caggtagtccatggacattaatt

SEQ ID NO: 597 - RNA, 23 nt, Homo sapiens
  source 1..23: mol_type = genomic RNA
tgagttggaagactggaaagaca

SEQ ID NO: 598 - RNA, 23 nt, Homo sapiens
  source 1..23: mol_type = genomic RNA
actggaaagacaacaaacattat

SEQ ID NO: 599 - RNA, 23 nt, Homo sapiens
  source 1..23: mol_type = genomic RNA
tttttacttgggaaatcacgaaa

SEQ ID NO: 600 - RNA, 23 nt, Homo sapiens
  source 1..23: mol_type = genomic RNA
ttgggaaatcacgaaaccaacta

SEQ ID NO: 601 - RNA, 23 nt, Homo sapiens
  source 1..23: mol_type = genomic RNA
gggaaatcacgaaaccaactata

SEQ ID NO: 602 - RNA, 23 nt, Homo sapiens
  source 1..23: mol_type = genomic RNA
cacgaaaccaactatacgctaca

SEQ ID NO: 603 - RNA, 23 nt, Homo sapiens
  source 1..23: mol_type = genomic RNA
aaatcaaccaaaatgttgatcca

SEQ ID NO: 604 - RNA, 23 nt, Homo sapiens
  source 1..23: mol_type = genomic RNA
tgttaaaactctaaacttgacta

SEQ ID NO: 605 - RNA, 23 nt, Homo sapiens
  source 1..23: mol_type = genomic RNA
ctcaaaacttgaaagcctcctag

SEQ ID NO: 606 - RNA, 23 nt, Homo sapiens
  source 1..23: mol_type = genomic RNA
attcaacatcgaatagatggatc

SEQ ID NO: 607 - RNA, 23 nt, Homo sapiens
  source 1..23: mol_type = genomic RNA
cacaaaacttcaatgaaacgtgg

SEQ ID NO: 608 - RNA, 23 nt, Homo sapiens
  source 1..23: mol_type = genomic RNA
gaaatcacgaaaccaactatacg

SEQ ID NO: 609 - RNA, 23 nt, Homo sapiens
  source 1..23: mol_type = genomic RNA
gtgggaatcaattttagatggtc

SEQ ID NO: 610 - RNA, 23 nt, Homo sapiens
  source 1..23: mol_type = genomic RNA
accaaaatgttgatccatccaac

SEQ ID NO: 611 - RNA, 23 nt, Homo sapiens
  source 1..23: mol_type = genomic RNA
catggacattaattcaacatcga

SEQ ID NO: 612 - RNA, 21 nt, synthetic construct
  source 1..21: mol_type = other RNA; note = Description of Artificial Sequence: Synthetic oligonucleotide
aagctccttctttttattgta

SEQ ID NO: 613 - RNA, 19 nt, synthetic construct
  source 1..19: mol_type = other RNA; note = Description of Artificial Sequence: Synthetic oligonucleotide
gctccttctttttattgtt

SEQ ID NO: 614 - RNA, 21 nt, synthetic construct
  source 1..21: mol_type = other RNA; note = Description of Artificial Sequence: Synthetic oligonucleotide
aagcaccttctttttattgtt

SEQ ID NO: 615 - RNA, 21 nt, synthetic construct
  source 1..21: mol_type = other RNA; note = Description of Artificial Sequence: Synthetic oligonucleotide
aaggtccttctttttattgtt

SEQ ID NO: 616 - RNA, 21 nt, synthetic construct
  source 1..21: mol_type = other RNA; note = Description of Artificial Sequence: Synthetic oligonucleotide
aacctccttctttttattgtt

SEQ ID NO: 617 - RNA, 21 nt, synthetic construct
  source 1..21: mol_type = other RNA; note = Description of Artificial Sequence: Synthetic oligonucleotide
agctccttctttttattgtta

SEQ ID NO: 618 - RNA, 19 nt, synthetic construct
  source 1..19: mol_type = other RNA; note = Description of Artificial Sequence: Synthetic oligonucleotide
ctccttctttttattgttt

SEQ ID NO: 619 - RNA, 21 nt, synthetic construct
  source 1..21: mol_type = other RNA; note = Description of Artificial Sequence: Synthetic oligonucleotide
agctgcttctttttattgttt

SEQ ID NO: 620 - RNA, 21 nt, synthetic construct
  source 1..21: mol_type = other RNA; note = Description of Artificial Sequence: Synthetic oligonucleotide
agcaccttctttttattgttt

SEQ ID NO: 621 - RNA, 21 nt, synthetic construct
  source 1..21: mol_type = other RNA; note = Description of Artificial Sequence: Synthetic oligonucleotide
aggtccttctttttattgttt

SEQ ID NO: 622 - RNA, 19 nt, synthetic construct
  source 1..19: mol_type = other RNA; note = Description of Artificial Sequence: Synthetic oligonucleotide
agaagtaacttcacttaaa

SEQ ID NO: 623 - RNA, 21 nt, synthetic construct
  source 1..21: mol_type = other RNA; note = Description of Artificial Sequence: Synthetic oligonucleotide
ccagtagtaacttcacttaaa

SEQ ID NO: 624 - RNA, 21 nt, synthetic construct
  source 1..21: mol_type = other RNA; note = Description of Artificial Sequence: Synthetic oligonucleotide
ccacaagtaacttcacttaaa

SEQ ID NO: 625 - RNA, 21 nt, synthetic construct
  source 1..21: mol_type = other RNA; note = Description of Artificial Sequence: Synthetic oligonucleotide
cctgaagtaacttcacttaaa

SEQ ID NO: 626 - RNA, 21 nt, synthetic construct
  source 1..21: mol_type = other RNA; note = Description of Artificial Sequence: Synthetic oligonucleotide
tgttgacaattaagctccttt

SEQ ID NO: 627 - RNA, 21 nt, synthetic construct
  source 1..21: mol_type = other RNA; note = Description of Artificial Sequence: Synthetic oligonucleotide
tgtacacaattaagctccttt

SEQ ID NO: 628 - RNA, 21 nt, synthetic construct
  source 1..21: mol_type = other RNA; note = Description of Artificial Sequence: Synthetic oligonucleotide
tgatcacaattaagctccttt

SEQ ID NO: 629 - RNA, 21 nt, synthetic construct
  source 1..21: mol_type = other RNA; note = Description of Artificial Sequence: Synthetic oligonucleotide
cacaattaagctccttcttta

SEQ ID NO: 630 - RNA, 19 nt, synthetic construct
  source 1..19: mol_type = other RNA; note = Description of Artificial Sequence: Synthetic oligonucleotide
caattaagctccttctttt

SEQ ID NO: 631 - RNA, 21 nt, synthetic construct
  source 1..21: mol_type = other RNA; note = Description of Artificial Sequence: Synthetic oligonucleotide
cacatttaagctccttctttt

SEQ ID NO: 632 - RNA, 21 nt, synthetic construct
  source 1..21: mol_type = other RNA; note = Description of Artificial Sequence: Synthetic oligonucleotide
cactattaagctccttctttt

SEQ ID NO: 633 - RNA, 21 nt, synthetic construct
  source 1..21: mol_type = other RNA; note = Description of Artificial Sequence: Synthetic oligonucleotide
cagaattaagctccttctttt

SEQ ID NO: 634 - RNA, 21 nt, synthetic construct
  source 1..21: mol_type = other RNA; note = Description of Artificial Sequence: Synthetic oligonucleotide
aattaagctccttctttttaa

SEQ ID NO: 635 - RNA, 19 nt, synthetic construct
  source 1..19: mol_type = other RNA; note = Description of Artificial Sequence: Synthetic oligonucleotide
ttaagctccttctttttat

SEQ ID NO: 636 - RNA, 21 nt, synthetic construct
  source 1..21: mol_type = other RNA; note = Description of Artificial Sequence: Synthetic oligonucleotide
aatttagctccttctttttat

SEQ ID NO: 637 - RNA, 21 nt, synthetic construct
  source 1..21: mol_type = other RNA; note = Description of Artificial Sequence: Synthetic oligonucleotide
aataaagctccttctttttat

SEQ ID NO: 638 - RNA, 21 nt, synthetic construct
  source 1..21: mol_type = other RNA; note = Description of Artificial Sequence: Synthetic oligonucleotide
aaataagctccttctttttat

SEQ ID NO: 639 - RNA, 21 nt, synthetic construct
  source 1..21: mol_type = other RNA; note = Description of Artificial Sequence: Synthetic oligonucleotide
tttgatcagtctttttatgaa

SEQ ID NO: 640 - RNA, 20 nt, synthetic construct
  source 1..20: mol_type = other RNA; note = Description of Artificial Sequence: Synthetic oligonucleotide
ttgatcagtctttttatgat

SEQ ID NO: 641 - RNA, 21 nt, synthetic construct
  source 1..21: mol_type = other RNA; note = Description of Artificial Sequence: Synthetic oligonucleotide
tttgttcagtctttttatgat

SEQ ID NO: 642 - RNA, 21 nt, synthetic construct
  source 1..21: mol_type = other RNA; note = Description of Artificial Sequence: Synthetic oligonucleotide
tttcatcagtctttttatgat

SEQ ID NO: 643 - RNA, 21 nt, synthetic construct
  source 1..21: mol_type = other RNA; note = Description of Artificial Sequence: Synthetic oligonucleotide
ttagatcagtctttttatgat

SEQ ID NO: 644 - RNA, 19 nt, synthetic construct
  source 1..19: mol_type = other RNA; note = Description of Artificial Sequence: Synthetic oligonucleotide
gaagtaacttcacttaaaa

SEQ ID NO: 645 - RNA, 21 nt, synthetic construct
  source 1..21: mol_type = other RNA; note = Description of Artificial Sequence: Synthetic oligonucleotide
acccagaagtaacttcactta

SEQ ID NO: 646 - RNA, 21 nt, synthetic construct
  source 1..21: mol_type = other RNA; note = Description of Artificial Sequence: Synthetic oligonucleotide
acccagaagtaactttacttt

SEQ ID NO: 647 - RNA, 19 nt, synthetic construct
  source 1..19: mol_type = other RNA; note = Description of Artificial Sequence: Synthetic oligonucleotide
ccagaagtaacttcacttt

SEQ ID NO: 648 - RNA, 21 nt, synthetic construct
  source 1..21: mol_type = other RNA; note = Description of Artificial Sequence: Synthetic oligonucleotide
accctgaagtaacttcacttt

SEQ ID NO: 649 - RNA, 21 nt, synthetic construct
  source 1..21: mol_type = other RNA; note = Description of Artificial Sequence: Synthetic oligonucleotide
accgagaagtaacttcacttt

SEQ ID NO: 650 - RNA, 21 nt, synthetic construct
  source 1..21: mol_type = other RNA; note = Description of Artificial Sequence: Synthetic oligonucleotide
acgcagaagtaacttcacttt

SEQ ID NO: 651 - RNA, 21 nt, synthetic construct
  source 1..21: mol_type = other RNA; note = Description of Artificial Sequence: Synthetic oligonucleotide
agaagtaacttcacttaaaaa

SEQ ID NO: 652 - RNA, 19 nt, synthetic construct
  source 1..19: mol_type = other RNA; note = Description of Artificial Sequence: Synthetic oligonucleotide
aagtaacttcacttaaaat

SEQ ID NO: 653 - RNA, 21 nt, synthetic construct
  source 1..21: mol_type = other RNA; note = Description of Artificial Sequence: Synthetic oligonucleotide
agaactaacttcacttaaaat

SEQ ID NO: 654 - RNA, 21 nt, synthetic construct
  source 1..21: mol_type = other RNA; note = Description of Artificial Sequence: Synthetic oligonucleotide
agatgtaacttcacttaaaat

SEQ ID NO: 655 - RNA, 21 nt, synthetic construct
  source 1..21: mol_type = other RNA; note = Description of Artificial Sequence: Synthetic oligonucleotide
agtagtaacttcacttaaaat

SEQ ID NO: 656 - RNA, 21 nt, synthetic construct
  source 1..21: mol_type = other RNA; note = Description of Artificial Sequence: Synthetic oligonucleotide
atttgctatgttagacgatga

SEQ ID NO: 657 - RNA, 19 nt, synthetic construct
  source 1..19: mol_type = other RNA; note = Description of Artificial Sequence: Synthetic oligonucleotide
ttgctatgttagacgatgt

SEQ ID NO: 658 - RNA, 21 nt, synthetic construct
  source 1..21: mol_type = other RNA; note = Description of Artificial Sequence: Synthetic oligonucleotide
atttcctatgttagacgatgt

SEQ ID NO: 659 - RNA, 21 nt, synthetic construct
  source 1..21: mol_type = other RNA; note = Description of Artificial Sequence: Synthetic oligonucleotide
attagctatgttagacgatgt

SEQ ID NO: 660 - RNA, 21 nt, synthetic construct
  source 1..21: mol_type = other RNA; note = Description of Artificial Sequence: Synthetic oligonucleotide
atatgctatgttagacgatgt

SEQ ID NO: 661 - RNA, 23 nt, synthetic construct
  source 1..23: mol_type = other RNA; note = Description of Artificial Sequence: Synthetic oligonucleotide
aacaataaaaagaaggagcttgg

SEQ ID NO: 662 - RNA, 23 nt, synthetic construct
  source 1..23: mol_type = other RNA; note = Description of Artificial Sequence: Synthetic oligonucleotide
tacaataaaaagaaggagcttgg

SEQ ID NO: 663 - RNA, 23 nt, synthetic construct
  source 1..23: mol_type = other RNA; note = Description of Artificial Sequence: Synthetic oligonucleotide
aacaataaaaagaaggagcttct

SEQ ID NO: 664 - RNA, 21 nt, synthetic construct
  source 1..21: mol_type = other RNA; note = Description of Artificial Sequence: Synthetic oligonucleotide
aacaataaaaagaaggagctt

SEQ ID NO: 665 - RNA, 23 nt, synthetic construct
  source 1..23: mol_type = other RNA; note = Description of Artificial Sequence: Synthetic oligonucleotide
aacaataaaaagaaggtgcttct

SEQ ID NO: 666 - RNA, 23 nt, synthetic construct
  source 1..23: mol_type = other RNA; note = Description of Artificial Sequence: Synthetic oligonucleotide
aacaataaaaagaaggaccttct

SEQ ID NO: 667 - RNA, 23 nt, synthetic construct
  source 1..23: mol_type = other RNA; note = Description of Artificial Sequence: Synthetic oligonucleotide
aacaataaaaagaaggaggttct

SEQ ID NO: 668 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 7: mod_base = OTHER; note = Thymine
aaacaataaaaagaaggagctta

SEQ ID NO: 669 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 7: mod_base = OTHER; note = Thymine
aaacaataaaaagaaggagcttg

SEQ ID NO: 670 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 7: mod_base = OTHER; note = Thymine
taacaataaaaagaaggagcttg

SEQ ID NO: 671 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 7: mod_base = OTHER; note = Thymine
aaacaataaaaagaaggagctct

SEQ ID NO: 672 - RNA, 21 nt, synthetic construct
  source 1..21: mol_type = other RNA; note = Description of Artificial Sequence: Synthetic oligonucleotide; note = Description of Combined DNA/RNA Molecule: Synthetic oligonucleotide
  modified_base 7: mod_base = OTHER; note = Thymine
aaacaataaaaagaaggagct

SEQ ID NO: 673 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 7: mod_base = OTHER; note = Thymine
aaacaataaaaagaagcagctct

SEQ ID NO: 674 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 7: mod_base = OTHER; note = Thymine
aaacaataaaaagaaggtgctct

SEQ ID NO: 675 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 7: mod_base = OTHER; note = Thymine
aaacaataaaaagaaggtcctct

SEQ ID NO: 676 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 2: mod_base = OTHER; note = Thymine
  modified_base 7: mod_base = OTHER; note = Thymine
tttaagtgaagttacttctgggt

SEQ ID NO: 677 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 7: mod_base = OTHER; note = Thymine
  modified_base 12: mod_base = OTHER; note = Thymine
tttaagtgaagttacttctgggt

SEQ ID NO: 678 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 7: mod_base = OTHER; note = Thymine
  modified_base 12: mod_base = OTHER; note = Thymine
  modified_base 16: mod_base = OTHER; note = Thymine
tttaagtgaagttacttctgggt

SEQ ID NO: 679 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 2: mod_base = OTHER; note = Thymine
  modified_base 7: mod_base = OTHER; note = Thymine
tttaagtgaagttacttctggct

SEQ ID NO: 680 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 7: mod_base = OTHER; note = Thymine
  modified_base 12: mod_base = OTHER; note = Thymine
tttaagtgaagttacttctggct

SEQ ID NO: 681 - RNA, 21 nt, synthetic construct
  source 1..21: mol_type = other RNA; note = Description of Artificial Sequence: Synthetic oligonucleotide; note = Description of Combined DNA/RNA Molecule: Synthetic oligonucleotide
  modified_base 2: mod_base = OTHER; note = Thymine
  modified_base 7: mod_base = OTHER; note = Thymine
tttaagtgaagttacttctgg

SEQ ID NO: 682 - RNA, 21 nt, synthetic construct
  source 1..21: mol_type = other RNA; note = Description of Artificial Sequence: Synthetic oligonucleotide; note = Description of Combined DNA/RNA Molecule: Synthetic oligonucleotide
  modified_base 7: mod_base = OTHER; note = Thymine
  modified_base 12: mod_base = OTHER; note = Thymine
tttaagtgaagttacttctgg

SEQ ID NO: 683 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 2: mod_base = OTHER; note = Thymine
  modified_base 7: mod_base = OTHER; note = Thymine
  modified_base 12: mod_base = OTHER; note = Thymine
tttaagtgaagttacttctgggt

SEQ ID NO: 684 - RNA, 21 nt, synthetic construct
  source 1..21: mol_type = other RNA; note = Description of Artificial Sequence: Synthetic oligonucleotide; note = Description of Combined DNA/RNA Molecule: Synthetic oligonucleotide
  modified_base 2: mod_base = OTHER; note = Thymine
  modified_base 7: mod_base = OTHER; note = Thymine
  modified_base 12: mod_base = OTHER; note = Thymine
tttaagtgaagttacttctgg

SEQ ID NO: 685 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 2: mod_base = OTHER; note = Thymine
  modified_base 12: mod_base = OTHER; note = Thymine
tttaagtgaagttacttctggct

SEQ ID NO: 686 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 7: mod_base = OTHER; note = Thymine
tttaagtgaagttactactgggt

SEQ ID NO: 687 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 7: mod_base = OTHER; note = Thymine
tttaagtgaagttacttgtgggt

SEQ ID NO: 688 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 7: mod_base = OTHER; note = Thymine
tttaagtgaagttacttcagggt

SEQ ID NO: 689 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 14: mod_base = OTHER; note = Thymine
  modified_base 16: mod_base = OTHER; note = Thymine
aaaggagcttaattgtgaacatt

SEQ ID NO: 690 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 14: mod_base = OTHER; note = Thymine
  modified_base 16: mod_base = OTHER; note = Thymine
aaaggagcttaattgtgaacact

SEQ ID NO: 691 - RNA, 23 nt, synthetic construct
  source 1..23: mol_type = other RNA; note = Description of Artificial Sequence: Synthetic oligonucleotide
aaaggagcttaattgtgaacagg

SEQ ID NO: 692 - RNA, 21 nt, synthetic construct
  source 1..21: mol_type = other RNA; note = Description of Artificial Sequence: Synthetic oligonucleotide
aaaggagcttaattgtgaacg

SEQ ID NO: 693 - RNA, 23 nt, synthetic construct
  source 1..23: mol_type = other RNA; note = Description of Artificial Sequence: Synthetic oligonucleotide
aaaggagcttaattgtcaacatt

SEQ ID NO: 694 - RNA, 23 nt, synthetic construct
  source 1..23: mol_type = other RNA; note = Description of Artificial Sequence: Synthetic oligonucleotide
aaaggagcttaattgtgtacatt

SEQ ID NO: 695 - RNA, 23 nt, synthetic construct
  source 1..23: mol_type = other RNA; note = Description of Artificial Sequence: Synthetic oligonucleotide
aaaggagcttaattgtgatcatt

SEQ ID NO: 696 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 14: mod_base = OTHER; note = Thymine
aaaagaaggagcttaattgtgaa

SEQ ID NO: 697 - RNA, 23 nt, synthetic construct
  source 1..23: mol_type = other RNA; note = Description of Artificial Sequence: Synthetic oligonucleotide
aaaagaaggagcttaattgtggg

SEQ ID NO: 698 - RNA, 23 nt, synthetic construct
  source 1..23: mol_type = other RNA; note = Description of Artificial Sequence: Synthetic oligonucleotide
taaagaaggagcttaattgtggg

SEQ ID NO: 699 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 14: mod_base = OTHER; note = Thymine
aaaagaaggagcttaattgtggg

SEQ ID NO: 700 - RNA, 23 nt, synthetic construct
  source 1..23: mol_type = other RNA; note = Description of Artificial Sequence: Synthetic oligonucleotide
aaaagaaggagcttaattgtgct

SEQ ID NO: 701 - RNA, 23 nt, synthetic construct
  source 1..23: mol_type = other RNA; note = Description of Artificial Sequence: Synthetic oligonucleotide
taaagaaggagcttaattgtgct

SEQ ID NO: 702 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 14: mod_base = OTHER; note = Thymine
aaaagaaggagcttaattgtgct

SEQ ID NO: 703 - RNA, 21 nt, synthetic construct
  source 1..21: mol_type = other RNA; note = Description of Artificial Sequence: Synthetic oligonucleotide
aaaagaaggagcttaattgtg

SEQ ID NO: 704 - RNA, 21 nt, synthetic construct
  source 1..21: mol_type = other RNA; note = Description of Artificial Sequence: Synthetic oligonucleotide; note = Description of Combined DNA/RNA Molecule: Synthetic oligonucleotide
  modified_base 14: mod_base = OTHER; note = Thymine
aaaagaaggagcttaattgtg

SEQ ID NO: 705 - RNA, 23 nt, synthetic construct
  source 1..23: mol_type = other RNA; note = Description of Artificial Sequence: Synthetic oligonucleotide
aaaagaaggagcttaaatgtgct

SEQ ID NO: 706 - RNA, 23 nt, synthetic construct
  source 1..23: mol_type = other RNA; note = Description of Artificial Sequence: Synthetic oligonucleotide
aaaagaaggagcttaatagtgct

SEQ ID NO: 707 - RNA, 23 nt, synthetic construct
  source 1..23: mol_type = other RNA; note = Description of Artificial Sequence: Synthetic oligonucleotide
aaaagaaggagcttaattctgct

SEQ ID NO: 708 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 2: mod_base = OTHER; note = Thymine
ataaaaagaaggagcttaattgt

SEQ ID NO: 709 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 2: mod_base = OTHER; note = Thymine
ttaaaaagaaggagcttaattgt

SEQ ID NO: 710 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 2: mod_base = OTHER; note = Thymine
  modified_base 16: mod_base = OTHER; note = Thymine
ataaaaagaaggagcttaattgt

SEQ ID NO: 711 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 2: mod_base = OTHER; note = Thymine
  modified_base 16: mod_base = OTHER; note = Thymine
ttaaaaagaaggagcttaattgt

SEQ ID NO: 712 - RNA, 21 nt, synthetic construct
  source 1..21: mol_type = other RNA; note = Description of Artificial Sequence: Synthetic oligonucleotide; note = Description of Combined DNA/RNA Molecule: Synthetic oligonucleotide
  modified_base 2: mod_base = OTHER; note = Thymine
ataaaaagaaggagcttaatt

SEQ ID NO: 713 - RNA, 21 nt, synthetic construct
  source 1..21: mol_type = other RNA; note = Description of Artificial Sequence: Synthetic oligonucleotide; note = Description of Combined DNA/RNA Molecule: Synthetic oligonucleotide
  modified_base 2: mod_base = OTHER; note = Thymine
  modified_base 16: mod_base = OTHER; note = Thymine
ataaaaagaaggagcttaatt

SEQ ID NO: 714 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 2: mod_base = OTHER; note = Thymine
ataaaaagaaggagctaaattgt

SEQ ID NO: 715 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 2: mod_base = OTHER; note = Thymine
ataaaaagaaggagctttattgt

SEQ ID NO: 716 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 2: mod_base = OTHER; note = Thymine
ataaaaagaaggagcttatttgt

SEQ ID NO: 717 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 5: mod_base = OTHER; note = Thymine
atcataaaaagactgatcaaatg

SEQ ID NO: 718 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 5: mod_base = OTHER; note = Thymine
ttcataaaaagactgatcaaatg

SEQ ID NO: 719 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 2: mod_base = OTHER; note = Thymine
  modified_base 5: mod_base = OTHER; note = Thymine
atcataaaaagactgatcaaatg

SEQ ID NO: 720 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 2: mod_base = OTHER; note = Thymine
atcataaaaagactgatcaaatg

SEQ ID NO: 721 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 2: mod_base = OTHER; note = Thymine
  modified_base 5: mod_base = OTHER; note = Thymine
ttcataaaaagactgatcaaatg

SEQ ID NO: 722 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 2: mod_base = OTHER; note = Thymine
  modified_base 14: mod_base = OTHER; note = Thymine
atcataaaaagactgatcaaatg

SEQ ID NO: 723 - RNA, 22 nt, synthetic construct
  source 1..22: mol_type = other RNA; note = Description of Artificial Sequence: Synthetic oligonucleotide; note = Description of Combined DNA/RNA Molecule: Synthetic oligonucleotide
  modified_base 2: mod_base = OTHER; note = Thymine
atcataaaaagactgatcaact

SEQ ID NO: 724 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 2: mod_base = OTHER; note = Thymine
  modified_base 5: mod_base = OTHER; note = Thymine
atcataaaaagactgatcaaact

SEQ ID NO: 725 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 2: mod_base = OTHER; note = Thymine
  modified_base 5: mod_base = OTHER; note = Thymine
atcataaaaagactgaacaaatg

SEQ ID NO: 726 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 2: mod_base = OTHER; note = Thymine
  modified_base 5: mod_base = OTHER; note = Thymine
atcataaaaagactgatgaaatg

SEQ ID NO: 727 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 2: mod_base = OTHER; note = Thymine
  modified_base 5: mod_base = OTHER; note = Thymine
atcataaaaagactgatctaatg

SEQ ID NO: 728 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 2: mod_base = OTHER; note = Thymine
ttttaagtgaagttacttctggg

SEQ ID NO: 729 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 2: mod_base = OTHER; note = Thymine
  modified_base 14: mod_base = OTHER; note = Thymine
ttttaagtgaagttacttctggg

SEQ ID NO: 730 - RNA, 21 nt, synthetic construct
  source 1..21: mol_type = other RNA; note = Description of Artificial Sequence: Synthetic oligonucleotide; note = Description of Combined DNA/RNA Molecule: Synthetic oligonucleotide
  modified_base 2: mod_base = OTHER; note = Thymine
ttttaagtgaagttacttctg

SEQ ID NO: 731 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 5: mod_base = OTHER; note = Thymine
aaagtgaagttacttctgggtgt

SEQ ID NO: 732 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 5: mod_base = OTHER; note = Thymine
taagtgaagttacttctgggtgt

SEQ ID NO: 733 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 5: mod_base = OTHER; note = Thymine
aaagtaaagttacttctgggtgt

SEQ ID NO: 734 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 5: mod_base = OTHER; note = Thymine
aaagtgaagttacttctgggtct

SEQ ID NO: 735 - RNA, 21 nt, synthetic construct
  source 1..21: mol_type = other RNA; note = Description of Artificial Sequence: Synthetic oligonucleotide; note = Description of Combined DNA/RNA Molecule: Synthetic oligonucleotide
  modified_base 5: mod_base = OTHER; note = Thymine
aaagtgaagttacttctgggt

SEQ ID NO: 736 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 5: mod_base = OTHER; note = Thymine
aaagtgaagttacttcagggtgt

SEQ ID NO: 737 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 5: mod_base = OTHER; note = Thymine
aaagtgaagttacttctcggtgt

SEQ ID NO: 738 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 5: mod_base = OTHER; note = Thymine
aaagtgaagttacttctgcgtgt

SEQ ID NO: 739 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 5: mod_base = OTHER; note = Thymine
attttaagtgaagttacttctgg

SEQ ID NO: 740 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 5: mod_base = OTHER; note = Thymine
tttttaagtgaagttacttctgg

SEQ ID NO: 741 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 2: mod_base = OTHER; note = Thymine
  modified_base 5: mod_base = OTHER; note = Thymine
attttaagtgaagttacttctgg

SEQ ID NO: 742 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 2: mod_base = OTHER; note = Thymine
  modified_base 5: mod_base = OTHER; note = Thymine
attttaagtgaagttacttctct

SEQ ID NO: 743 - RNA, 21 nt, synthetic construct
  source 1..21: mol_type = other RNA; note = Description of Artificial Sequence: Synthetic oligonucleotide; note = Description of Combined DNA/RNA Molecule: Synthetic oligonucleotide
  modified_base 2: mod_base = OTHER; note = Thymine
  modified_base 5: mod_base = OTHER; note = Thymine
attttaagtgaagttacttct

SEQ ID NO: 744 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 5: mod_base = OTHER; note = Thymine
attttaagtgaagttagttctgg

SEQ ID NO: 745 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 5: mod_base = OTHER; note = Thymine
attttaagtgaagttacatctgg

SEQ ID NO: 746 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 5: mod_base = OTHER; note = Thymine
attttaagtgaagttactactgg

SEQ ID NO: 747 - RNA, 23 nt, synthetic construct
  source 1..23: mol_type = other RNA; note = Description of Artificial Sequence: Synthetic oligonucleotide
acatcgtctaacatagcaaatct

SEQ ID NO: 748 - RNA, 23 nt, synthetic construct
  source 1..23: mol_type = other RNA; note = Description of Artificial Sequence: Synthetic oligonucleotide; note = Description of Combined DNA/RNA Molecule: Synthetic oligonucleotide
  modified_base 7: mod_base = OTHER; note = Thymine
tcatcgtctaacatagcaaatct

SEQ ID NO: 749 - RNA, 23 nt, synthetic construct
  source 1..23: mol_type = other RNA; note = Description of Artificial Sequence: Synthetic oligonucleotide
tcatcgtctaacatagcaaatct

SEQ ID NO: 750 - RNA, 21 nt, synthetic construct
  source 1..21: mol_type = other RNA; note = Description of Artificial Sequence: Synthetic oligonucleotide; note = Description of Combined DNA/RNA Molecule: Synthetic oligonucleotide
  modified_base 7: mod_base = OTHER; note = Thymine
acatcgtctaacatagcaagt

SEQ ID NO: 751 - RNA, 21 nt, synthetic construct
  source 1..21: mol_type = other RNA; note = Description of Artificial Sequence: Synthetic oligonucleotide
acatcgtctaacatagcaagt

SEQ ID NO: 752 - RNA, 23 nt, synthetic construct
  source 1..23: mol_type = other RNA; note = Description of Artificial Sequence: Synthetic oligonucleotide
acatcgtctaacataggaaatct

SEQ ID NO: 753 - RNA, 23 nt, synthetic construct
  source 1..23: mol_type = other RNA; note = Description of Artificial Sequence: Synthetic oligonucleotide
acatcgtctaacatagctaatct

SEQ ID NO: 754 - RNA, 23 nt, synthetic construct
  source 1..23: mol_type = other RNA; note = Description of Artificial Sequence: Synthetic oligonucleotide
acatcgtctaacatagcatatct

SEQ ID NO: 755 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-fluorouridine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note 2'-O-methyladenosine-3'-phosphate-N-[tris(GalNAc-alkyl)-ami dodecanoyl)]-4-hydroxyprolinol (Hyp-(GalNAc-alkyl)3)
aagctccttctttttattgta

SEQ ID NO: 756 - RNA, 19 nt, synthetic construct
  source 1..19: mol_type = other RNA; note = Description of Artificial Sequence: Synthetic oligonucleotide
  modified_base 1: mod_base = OTHER; note = 2'-O-methylguanosine-3'- phosphorothioate
  modified_base 2: mod_base = OTHER; note = 2'-O-methylcytidine-3'- phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-fluorouridine-3'-phosphate
  modified_base 8: mod_base = OTHER; note = 2'-fluorocytidine-3'-phosphate
  modified_base 9: mod_base = OTHER; note = 2'-fluorouridine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note 2'-O-methyluridine-3'-phosphate-N-[tris(GalNAc-alkyl)-amido decanoyl)]-4-hydroxyprolinol (Hyp-(GalNAc-alkyl)3)
gctccttctttttattgtt

SEQ ID NO: 757 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-fluorouridine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note 2'-O-methyluridine-3'-phosphate-N-[tris(GalNAc-alkyl)-amido decanoyl)]-4-hydroxyprolinol (Hyp-(GalNAc-alkyl)3)
aagcaccttctttttattgtt

SEQ ID NO: 758 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-fluorouridine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note 2'-O-methyluridine-3'-phosphate-N-[tris(GalNAc-alkyl)-amido decanoyl)]-4-hydroxyprolinol (Hyp-(GalNAc-alkyl)3)
aaggtccttctttttattgtt

SEQ ID NO: 759 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-fluorouridine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note 2'-O-methyluridine-3'-phosphate-N-[tris(GalNAc-alkyl)-amido decanoyl)]-4-hydroxyprolinol (Hyp-(GalNAc-alkyl)3)
aacctccttctttttattgtt

SEQ ID NO: 760 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methylguanosine-3'- phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-fluorocytidine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note 2'-O-methyluridine-3'-phosphate-N-[tris(GalNAc-alkyl)-amido decanoyl)]-4-hydroxyprolinol (Hyp-(GalNAc-alkyl)3)
agctccttctttttattgttt

SEQ ID NO: 761 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methylguanosine-3'- phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-fluorocytidine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note 2'-O-methyladenosine-3'-phosphate-N-[tris(GalNAc-alkyl)-ami dodecanoyl)]-4-hydroxyprolinol (Hyp-(GalNAc-alkyl)3)
agctccttctttttattgtta

SEQ ID NO: 762 - RNA, 19 nt, synthetic construct
  source 1..19: mol_type = other RNA; note = Description of Artificial Sequence: Synthetic oligonucleotide
  modified_base 1: mod_base = OTHER; note = 2'-O-methylcytidine-3'- phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-fluorocytidine-3'-phosphate
  modified_base 8: mod_base = OTHER; note = 2'-fluorouridine-3'-phosphate
  modified_base 9: mod_base = OTHER; note = 2'-fluorouridine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note 2'-O-methyluridine-3'-phosphate-N-[tris(GalNAc-alkyl)-amido decanoyl)]-4-hydroxyprolinol (Hyp-(GalNAc-alkyl)3)
ctccttctttttattgttt

SEQ ID NO: 763 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methylguanosine-3'- phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-fluorocytidine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note 2'-O-methyluridine-3'-phosphate-N-[tris(GalNAc-alkyl)-amido decanoyl)]-4-hydroxyprolinol (Hyp-(GalNAc-alkyl)3)
agctgcttctttttattgttt

SEQ ID NO: 764 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methylguanosine-3'- phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-fluorocytidine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note 2'-O-methyluridine-3'-phosphate-N-[tris(GalNAc-alkyl)-amido decanoyl)]-4-hydroxyprolinol (Hyp-(GalNAc-alkyl)3)
agcaccttctttttattgttt

SEQ ID NO: 765 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methylguanosine-3'- phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-fluorocytidine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note 2'-O-methyluridine-3'-phosphate-N-[tris(GalNAc-alkyl)-amido decanoyl)]-4-hydroxyprolinol (Hyp-(GalNAc-alkyl)3)
aggtccttctttttattgttt

SEQ ID NO: 766 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'- phosphorothioate
  modified_base 2: mod_base = OTHER; note = 2'-O-methylcytidine-3'- phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluorocytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note 2'-O-methyladenosine-3'-phosphate-N-[tris(GalNAc-alkyl)-ami dodecanoyl)]-4-hydroxyprolinol (Hyp-(GalNAc-alkyl)3)
ccagaagtaacttcacttaaa

SEQ ID NO: 767 - RNA, 19 nt, synthetic construct
  source 1..19: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methylguanosine-3'- phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-fluoroadenosine-3'-phosphate
  modified_base 8: mod_base = OTHER; note = 2'-fluoroadenosine-3'-phosphate
  modified_base 9: mod_base = OTHER; note = 2'-fluorocytidine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note 2'-O-methyladenosine-3'-phosphate-N-[tris(GalNAc-alkyl)-ami dodecanoyl)]-4-hydroxyprolinol (Hyp-(GalNAc-alkyl)3)
agaagtaacttcacttaaa

SEQ ID NO: 768 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylcytidine-3'- phosphorothioate
  modified_base 2: mod_base = OTHER; note = 2'-O-methylcytidine-3'- phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-O-methylguanosine-3'-phosphate
  modified_base 8: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-fluorocytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note 2'-O-methyladenosine-3'-phosphate-N-[tris(GalNAc-alkyl)-ami dodecanoyl)]-4-hydroxyprolinol (Hyp-(GalNAc-alkyl)3)
  misc_feature 1..8: note = RNA
  misc_feature 9: note = DNA
  misc_feature 10..21: note = RNA
ccagaagtaacttcacttaaa

SEQ ID NO: 769 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylcytidine-3'- phosphorothioate
  modified_base 2: mod_base = OTHER; note = 2'-O-methylcytidine-3'- phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-O-methylguanosine-3'-phosphate
  modified_base 8: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-fluorocytidine-3'-phosphate
  modified_base 12: mod_base = OTHER; note = 2'-fluorouridine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note 2'-O-methyladenosine-3'-phosphate-N-[tris(GalNAc-alkyl)-ami dodecanoyl)]-4-hydroxyprolinol (Hyp-(GalNAc-alkyl)3)
  misc_feature 1..8: note = RNA
  misc_feature 9: note = DNA
  misc_feature 10..21: note = RNA
ccagaagtaacttcacttaaa

SEQ ID NO: 770 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'- phosphorothioate
  modified_base 2: mod_base = OTHER; note = 2'-O-methylcytidine-3'- phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluorocytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note 2'-O-methyladenosine-3'-phosphate-N-[tris(GalNAc-alkyl)-ami dodecanoyl)]-4-hydroxyprolinol (Hyp-(GalNAc-alkyl)3)
ccagtagtaacttcacttaaa

SEQ ID NO: 771 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'- phosphorothioate
  modified_base 2: mod_base = OTHER; note = 2'-O-methylcytidine-3'- phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluorocytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note 2'-O-methyladenosine-3'-phosphate-N-[tris(GalNAc-alkyl)-ami dodecanoyl)]-4-hydroxyprolinol (Hyp-(GalNAc-alkyl)3)
ccacaagtaacttcacttaaa

SEQ ID NO: 772 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'- phosphorothioate
  modified_base 2: mod_base = OTHER; note = 2'-O-methylcytidine-3'- phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluorocytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note 2'-O-methyladenosine-3'-phosphate-N-[tris(GalNAc-alkyl)-ami dodecanoyl)]-4-hydroxyprolinol (Hyp-(GalNAc-alkyl)3)
cctgaagtaacttcacttaaa

SEQ ID NO: 773 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methylguanosine-3'- phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note 2'-O-methyluridine-3'-phosphate-N-[tris(GalNAc-alkyl)-amido decanoyl)]-4-hydroxyprolinol (Hyp-(GalNAc-alkyl)3)
tgttcacaattaagctccttt

SEQ ID NO: 774 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methylguanosine-3'- phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-fluorocytidine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note 2'-O-methyluridine-3'-phosphate-N-[tris(GalNAc-alkyl)-amido decanoyl)]-4-hydroxyprolinol (Hyp-(GalNAc-alkyl)3)
tgttgacaattaagctccttt

SEQ ID NO: 775 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methylguanosine-3'- phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-fluorocytidine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note 2'-O-methyluridine-3'-phosphate-N-[tris(GalNAc-alkyl)-amido decanoyl)]-4-hydroxyprolinol (Hyp-(GalNAc-alkyl)3)
tgtacacaattaagctccttt

SEQ ID NO: 776 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methylguanosine-3'- phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-fluorocytidine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note 2'-O-methyluridine-3'-phosphate-N-[tris(GalNAc-alkyl)-amido decanoyl)]-4-hydroxyprolinol (Hyp-(GalNAc-alkyl)3)
tgatcacaattaagctccttt

SEQ ID NO: 777 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluorocytidine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note 2'-O-methyluridine-3'-phosphate-N-[tris(GalNAc-alkyl)-amido decanoyl)]-4-hydroxyprolinol (Hyp-(GalNAc-alkyl)3)
cacaattaagctccttctttt

SEQ ID NO: 778 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluorocytidine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note 2'-O-methyladenosine-3'-phosphate-N-[tris(GalNAc-alkyl)-ami dodecanoyl)]-4-hydroxyprolinol (Hyp-(GalNAc-alkyl)3)
cacaattaagctccttcttta

SEQ ID NO: 779 - RNA, 19 nt, synthetic construct
  source 1..19: mol_type = other RNA; note = Description of Artificial Sequence: Synthetic oligonucleotide
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = 2'-fluoroadenosine-3'-phosphate
  modified_base 8: mod_base = OTHER; note = 2'-fluoroguanosine-3'-phosphate
  modified_base 9: mod_base = OTHER; note = 2'-fluorocytidine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note 2'-O-methyluridine-3'-phosphate-N-[tris(GalNAc-alkyl)-amido decanoyl)]-4-hydroxyprolinol (Hyp-(GalNAc-alkyl)3)
caattaagctccttctttt

SEQ ID NO: 780 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluorocytidine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note 2'-O-methyluridine-3'-phosphate-N-[tris(GalNAc-alkyl)-amido decanoyl)]-4-hydroxyprolinol (Hyp-(GalNAc-alkyl)3)
cacatttaagctccttctttt

SEQ ID NO: 781 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluorocytidine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note 2'-O-methyluridine-3'-phosphate-N-[tris(GalNAc-alkyl)-amido decanoyl)]-4-hydroxyprolinol (Hyp-(GalNAc-alkyl)3)
cactattaagctccttctttt

SEQ ID NO: 782 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluorocytidine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note 2'-O-methyluridine-3'-phosphate-N-[tris(GalNAc-alkyl)-amido decanoyl)]-4-hydroxyprolinol (Hyp-(GalNAc-alkyl)3)
cagaattaagctccttctttt

SEQ ID NO: 783 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-O-methyluridine-3'-phosphate
  modified_base 8: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-fluorocytidine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note 2'-O-methyluridine-3'-phosphate-N-[tris(GalNAc-alkyl)-amido decanoyl)]-4-hydroxyprolinol (Hyp-(GalNAc-alkyl)3)
  misc_feature 1..8: note = RNA
  misc_feature 9: note = DNA
  misc_feature 10..21: note = RNA
cacaattaagctccttctttt

SEQ ID NO: 784 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-O-methyluridine-3'-phosphate
  modified_base 8: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-fluorocytidine-3'-phosphate
  modified_base 12: mod_base = OTHER; note = 2'-fluorouridine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note 2'-O-methyluridine-3'-phosphate-N-[tris(GalNAc-alkyl)-amido decanoyl)]-4-hydroxyprolinol (Hyp-(GalNAc-alkyl)3)
  misc_feature 1..8: note = RNA
  misc_feature 9: note = DNA
  misc_feature 10..21: note = RNA
cacaattaagctccttctttt

SEQ ID NO: 785 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-O-methylguanosine-3'-phosphate
  modified_base 8: mod_base = OTHER; note = 2'-O-methylcytidine-3'-phosphate
  modified_base 9: mod_base = OTHER; note = 2'-fluorouridine-3'-phosphate
  modified_base 10: mod_base = OTHER; note = 2'-fluorocytidine-3'-phosphate
  modified_base 11: mod_base = OTHER; note = 2'-fluorocytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note 2'-O-methyluridine-3'-phosphate-N-[tris(GalNAc-alkyl)-amido decanoyl)]-4-hydroxyprolinol (Hyp-(GalNAc-alkyl)3)
aattaagctccttctttttat

SEQ ID NO: 786 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-O-methylguanosine-3'-phosphate
  modified_base 8: mod_base = OTHER; note = 2'-O-methylcytidine-3'-phosphate
  modified_base 9: mod_base = OTHER; note = 2'-fluorouridine-3'-phosphate
  modified_base 10: mod_base = OTHER; note = 2'-fluorocytidine-3'-phosphate
  modified_base 11: mod_base = OTHER; note = 2'-fluorocytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note 2'-O-methyladenosine-3'-phosphate-N-[tris(GalNAc-alkyl)-ami dodecanoyl)]-4-hydroxyprolinol (Hyp-(GalNAc-alkyl)3)
aattaagctccttctttttaa

SEQ ID NO: 787 - RNA, 19 nt, synthetic construct
  source 1..19: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = 2'-fluorouridine-3'-phosphate
  modified_base 8: mod_base = OTHER; note = 2'-fluorocytidine-3'-phosphate
  modified_base 9: mod_base = OTHER; note = 2'-fluorocytidine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note 2'-O-methyluridine-3'-phosphate-N-[tris(GalNAc-alkyl)-amido decanoyl)]-4-hydroxyprolinol (Hyp-(GalNAc-alkyl)3)
ttaagctccttctttttat

SEQ ID NO: 788 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = 2'-O-methylguanosine-3'-phosphate
  modified_base 8: mod_base = OTHER; note = 2'-O-methylcytidine-3'-phosphate
  modified_base 9: mod_base = OTHER; note = 2'-fluorouridine-3'-phosphate
  modified_base 10: mod_base = OTHER; note = 2'-fluorocytidine-3'-phosphate
  modified_base 11: mod_base = OTHER; note = 2'-fluorocytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note 2'-O-methyluridine-3'-phosphate-N-[tris(GalNAc-alkyl)-amido decanoyl)]-4-hydroxyprolinol (Hyp-(GalNAc-alkyl)3)
aatttagctccttctttttat

SEQ ID NO: 789 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-O-methylguanosine-3'-phosphate
  modified_base 8: mod_base = OTHER; note = 2'-O-methylcytidine-3'-phosphate
  modified_base 9: mod_base = OTHER; note = 2'-fluorouridine-3'-phosphate
  modified_base 10: mod_base = OTHER; note = 2'-fluorocytidine-3'-phosphate
  modified_base 11: mod_base = OTHER; note = 2'-fluorocytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note 2'-O-methyluridine-3'-phosphate-N-[tris(GalNAc-alkyl)-amido decanoyl)]-4-hydroxyprolinol (Hyp-(GalNAc-alkyl)3)
aataaagctccttctttttat

SEQ ID NO: 790 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-O-methylguanosine-3'-phosphate
  modified_base 8: mod_base = OTHER; note = 2'-O-methylcytidine-3'-phosphate
  modified_base 9: mod_base = OTHER; note = 2'-fluorouridine-3'-phosphate
  modified_base 10: mod_base = OTHER; note = 2'-fluorocytidine-3'-phosphate
  modified_base 11: mod_base = OTHER; note = 2'-fluorocytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note 2'-O-methyluridine-3'-phosphate-N-[tris(GalNAc-alkyl)-amido decanoyl)]-4-hydroxyprolinol (Hyp-(GalNAc-alkyl)3)
aaataagctccttctttttat

SEQ ID NO: 791 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-fluorocytidine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluorouridine-3'-phosphate
  modified_base 11: mod_base = OTHER; note = 2'-fluorocytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note 2'-O-methyladenosine-3'-phosphate-N-[tris(GalNAc-alkyl)-ami dodecanoyl)]-4-hydroxyprolinol (Hyp-(GalNAc-alkyl)3)
tttgatcagtctttttatgaa

SEQ ID NO: 792 - RNA, 20 nt, synthetic construct
  source 1..20: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-fluorocytidine-3'-phosphate
  modified_base 7: mod_base = OTHER; note = 2'-O-methyladenosine-3'-phosphate
  modified_base 8: mod_base = OTHER; note = 2'-fluoroguanosine-3'-phosphate
  modified_base 9: mod_base = OTHER; note = 2'-fluorouridine-3'-phosphate
  modified_base 10: mod_base = OTHER; note = 2'-fluorocytidine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note 2'-O-methyluridine-3'-phosphate-N-[tris(GalNAc-alkyl)-amido decanoyl)]-4-hydroxyprolinol (Hyp-(GalNAc-alkyl)3)
ttgatcagtctttttatgat

SEQ ID NO: 793 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-fluorocytidine-3'-phosphate
  modified_base 12: mod_base = OTHER; note = 2'-fluorouridine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note 2'-O-methyluridine-3'-phosphate-N-[tris(GalNAc-alkyl)-amido decanoyl)]-4-hydroxyprolinol (Hyp-(GalNAc-alkyl)3)
  misc_feature 1..8: note = RNA
  misc_feature 9: note = DNA
  misc_feature 10..21: note = RNA
tttgatcagtctttttatgat

SEQ ID NO: 794 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-fluorouridine-3'-phosphate
  modified_base 11: mod_base = OTHER; note = 2'-fluorocytidine-3'-phosphate
  modified_base 12: mod_base = OTHER; note = 2'-fluorouridine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note 2'-O-methyluridine-3'-phosphate-N-[tris(GalNAc-alkyl)-amido decanoyl)]-4-hydroxyprolinol (Hyp-(GalNAc-alkyl)3)
tttgatcagtctttttatgat

SEQ ID NO: 795 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-fluorocytidine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluorouridine-3'-phosphate
  modified_base 11: mod_base = OTHER; note = 2'-fluorocytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note 2'-O-methyluridine-3'-phosphate-N-[tris(GalNAc-alkyl)-amido decanoyl)]-4-hydroxyprolinol (Hyp-(GalNAc-alkyl)3)
tttgttcagtctttttatgat

SEQ ID NO: 796 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-fluorocytidine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluorouridine-3'-phosphate
  modified_base 11: mod_base = OTHER; note = 2'-fluorocytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note 2'-O-methyluridine-3'-phosphate-N-[tris(GalNAc-alkyl)-amido decanoyl)]-4-hydroxyprolinol (Hyp-(GalNAc-alkyl)3)
tttcatcagtctttttatgat

SEQ ID NO: 797 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-fluorocytidine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluorouridine-3'-phosphate
  modified_base 11: mod_base = OTHER; note = 2'-fluorocytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note 2'-O-methyluridine-3'-phosphate-N-[tris(GalNAc-alkyl)-amido decanoyl)]-4-hydroxyprolinol (Hyp-(GalNAc-alkyl)3)
ttagatcagtctttttatgat

SEQ ID NO: 798 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluorouridine-3'-phosphate
  modified_base 11: mod_base = OTHER; note = 2'-fluorocytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note 2'-O-methyluridine-3'-phosphate-N-[tris(GalNAc-alkyl)-amido decanoyl)]-4-hydroxyprolinol (Hyp-(GalNAc-alkyl)3)
tttgatcagtctttttatgat

SEQ ID NO: 799 - RNA, 19 nt, synthetic construct
  source 1..19: mol_type = other RNA; note = Description of Artificial Sequence: Synthetic oligonucleotide
  modified_base 1: mod_base = OTHER; note = 2'-O-methylguanosine-3'- phosphorothioate
  modified_base 2: mod_base = OTHER; note = 2'-O-methyladenosine-3'- phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-fluorouridine-3'-phosphate
  modified_base 6: mod_base = OTHER; note = 2'-O-methyladenosine-3'-phosphate
  modified_base 7: mod_base = OTHER; note = 2'-fluoroadenosine-3'-phosphate
  modified_base 8: mod_base = OTHER; note = 2'-fluorocytidine-3'-phosphate
  modified_base 9: mod_base = OTHER; note = 2'-fluorouridine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note 2'-O-methyladenosine-3'-phosphate-N-[tris(GalNAc-alkyl)-ami dodecanoyl)]-4-hydroxyprolinol (Hyp-(GalNAc-alkyl)3)
gaagtaacttcacttaaaa

SEQ ID NO: 800 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-fluorouridine-3'-phosphate
  modified_base 8: mod_base = OTHER; note = 2'-O-methyladenosine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note 2'-O-methyladenosine-3'-phosphate-N-[tris(GalNAc-alkyl)-ami dodecanoyl)]-4-hydroxyprolinol (Hyp-(GalNAc-alkyl)3)
  misc_feature 1..8: note = RNA
  misc_feature 9: note = DNA
  misc_feature 10..21: note = RNA
cagaagtaacttcacttaaaa

SEQ ID NO: 801 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-fluorouridine-3'-phosphate
  modified_base 8: mod_base = OTHER; note = 2'-O-methyladenosine-3'-phosphate
  modified_base 10: mod_base = OTHER; note = 2'-O-methylcytidine-3'-phosphate
  modified_base 11: mod_base = OTHER; note = 2'-fluorouridine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note 2'-O-methyladenosine-3'-phosphate-N-[tris(GalNAc-alkyl)-ami dodecanoyl)]-4-hydroxyprolinol (Hyp-(GalNAc-alkyl)3)
  misc_feature 1..8: note = RNA
  misc_feature 9: note = DNA
  misc_feature 10..21: note = RNA
cagaagtaacttcacttaaaa

SEQ ID NO: 802 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-O-methyluridine-3'-phosphate
  modified_base 8: mod_base = OTHER; note = 2'-O-methyladenosine-3'-phosphate
  modified_base 10: mod_base = OTHER; note = 2'-O-methylcytidine-3'-phosphate
  modified_base 11: mod_base = OTHER; note = 2'-fluorouridine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note 2'-O-methyladenosine-3'-phosphate-N-[tris(GalNAc-alkyl)-ami dodecanoyl)]-4-hydroxyprolinol (Hyp-(GalNAc-alkyl)3)
  misc_feature 1..8: note = RNA
  misc_feature 9: note = DNA
  misc_feature 10..21: note = RNA
cagaagtaacttcacttaaaa

SEQ ID NO: 803 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-O-methyluridine-3'-phosphate
  modified_base 8: mod_base = OTHER; note = 2'-O-methyladenosine-3'-phosphate
  modified_base 10: mod_base = OTHER; note = 2'-O-methylcytidine-3'-phosphate
  modified_base 11: mod_base = OTHER; note = 2'-fluorouridine-3'-phosphate
  modified_base 12: mod_base = OTHER; note = 2'-fluorouridine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note 2'-O-methyladenosine-3'-phosphate-N-[tris(GalNAc-alkyl)-ami dodecanoyl)]-4-hydroxyprolinol (Hyp-(GalNAc-alkyl)3)
  misc_feature 1..8: note = RNA
  misc_feature 9: note = DNA
  misc_feature 10..21: note = RNA
cagaagtaacttcacttaaaa

SEQ ID NO: 804 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 12: mod_base = OTHER; note = 2'-fluorouridine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note 2'-O-methyladenosine-3'-phosphate-N-[tris(GalNAc-alkyl)-ami dodecanoyl)]-4-hydroxyprolinol (Hyp-(GalNAc-alkyl)3)
cagaagtaacttcacttaaaa

SEQ ID NO: 805 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note 2'-O-methyladenosine-3'-phosphate-N-[tris(GalNAc-alkyl)-ami dodecanoyl)]-4-hydroxyprolinol (Hyp-(GalNAc-alkyl)3)
cagaagtaacttcacttaaaa

SEQ ID NO: 806 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methylcytidine-3'- phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluorouridine-3'-phosphate
  modified_base 11: mod_base = OTHER; note = 2'-fluoroadenosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note 2'-O-methyluridine-3'-phosphate-N-[tris(GalNAc-alkyl)-amido decanoyl)]-4-hydroxyprolinol (Hyp-(GalNAc-alkyl)3)
acccagaagtaacttcacttt

SEQ ID NO: 807 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methylcytidine-3'- phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluorouridine-3'-phosphate
  modified_base 11: mod_base = OTHER; note = 2'-fluoroadenosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note 2'-O-methyladenosine-3'-phosphate-N-[tris(GalNAc-alkyl)-ami dodecanoyl)]-4-hydroxyprolinol (Hyp-(GalNAc-alkyl)3)
acccagaagtaacttcactta

SEQ ID NO: 808 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methylcytidine-3'- phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluorouridine-3'-phosphate
  modified_base 11: mod_base = OTHER; note = 2'-fluoroadenosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note 2'-O-methyluridine-3'-phosphate-N-[tris(GalNAc-alkyl)-amido decanoyl)]-4-hydroxyprolinol (Hyp-(GalNAc-alkyl)3)
acccagaagtaactttacttt

SEQ ID NO: 809 - RNA, 19 nt, synthetic construct
  source 1..19: mol_type = other RNA; note = Description of Artificial Sequence: Synthetic oligonucleotide
  modified_base 1: mod_base = OTHER; note = 2'-O-methylcytidine-3'- phosphorothioate
  modified_base 2: mod_base = OTHER; note = 2'-O-methylcytidine-3'- phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-fluoroguanosine-3'-phosphate
  modified_base 8: mod_base = OTHER; note = 2'-fluorouridine-3'-phosphate
  modified_base 9: mod_base = OTHER; note = 2'-fluoroadenosine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note 2'-O-methyluridine-3'-phosphate-N-[tris(GalNAc-alkyl)-amido decanoyl)]-4-hydroxyprolinol (Hyp-(GalNAc-alkyl)3)
ccagaagtaacttcacttt

SEQ ID NO: 810 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methylcytidine-3'- phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluorouridine-3'-phosphate
  modified_base 11: mod_base = OTHER; note = 2'-fluoroadenosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note 2'-O-methyluridine-3'-phosphate-N-[tris(GalNAc-alkyl)-amido decanoyl)]-4-hydroxyprolinol (Hyp-(GalNAc-alkyl)3)
accctgaagtaacttcacttt

SEQ ID NO: 811 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methylcytidine-3'- phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluorouridine-3'-phosphate
  modified_base 11: mod_base = OTHER; note = 2'-fluoroadenosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note 2'-O-methyluridine-3'-phosphate-N-[tris(GalNAc-alkyl)-amido decanoyl)]-4-hydroxyprolinol (Hyp-(GalNAc-alkyl)3)
accgagaagtaacttcacttt

SEQ ID NO: 812 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methylcytidine-3'- phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluorouridine-3'-phosphate
  modified_base 11: mod_base = OTHER; note = 2'-fluoroadenosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note 2'-O-methyluridine-3'-phosphate-N-[tris(GalNAc-alkyl)-amido decanoyl)]-4-hydroxyprolinol (Hyp-(GalNAc-alkyl)3)
acgcagaagtaacttcacttt

SEQ ID NO: 813 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methylcytidine-3'- phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-fluorouridine-3'-phosphate
  modified_base 11: mod_base = OTHER; note = 2'-fluoroadenosine-3'-phosphate
  modified_base 12: mod_base = OTHER; note = 2'-fluoroadenosine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note 2'-O-methyluridine-3'-phosphate-N-[tris(GalNAc-alkyl)-amido decanoyl)]-4-hydroxyprolinol (Hyp-(GalNAc-alkyl)3)
acccagaagtaacttcacttt

SEQ ID NO: 814 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methylguanosine-3'- phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-fluorocytidine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note 2'-O-methyluridine-3'-phosphate-N-[tris(GalNAc-alkyl)-amido decanoyl)]-4-hydroxyprolinol (Hyp-(GalNAc-alkyl)3)
agaagtaacttcacttaaaat

SEQ ID NO: 815 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methylguanosine-3'- phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-fluorocytidine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note 2'-O-methyladenosine-3'-phosphate-N-[tris(GalNAc-alkyl)-ami dodecanoyl)]-4-hydroxyprolinol (Hyp-(GalNAc-alkyl)3)
agaagtaacttcacttaaaaa

SEQ ID NO: 816 - RNA, 19 nt, synthetic construct
  source 1..19: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-fluorocytidine-3'-phosphate
  modified_base 8: mod_base = OTHER; note = 2'-fluorouridine-3'-phosphate
  modified_base 9: mod_base = OTHER; note = 2'-fluorouridine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note 2'-O-methyluridine-3'-phosphate-N-[tris(GalNAc-alkyl)-amido decanoyl)]-4-hydroxyprolinol (Hyp-(GalNAc-alkyl)3)
aagtaacttcacttaaaat

SEQ ID NO: 817 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methylguanosine-3'- phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-fluorocytidine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note 2'-O-methyluridine-3'-phosphate-N-[tris(GalNAc-alkyl)-amido decanoyl)]-4-hydroxyprolinol (Hyp-(GalNAc-alkyl)3)
agaactaacttcacttaaaat

SEQ ID NO: 818 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methylguanosine-3'- phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-fluorocytidine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note 2'-O-methyluridine-3'-phosphate-N-[tris(GalNAc-alkyl)-amido decanoyl)]-4-hydroxyprolinol (Hyp-(GalNAc-alkyl)3)
agatgtaacttcacttaaaat

SEQ ID NO: 819 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methylguanosine-3'- phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-fluorocytidine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note 2'-O-methyluridine-3'-phosphate-N-[tris(GalNAc-alkyl)-amido decanoyl)]-4-hydroxyprolinol (Hyp-(GalNAc-alkyl)3)
agtagtaacttcacttaaaat

SEQ ID NO: 820 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluorouridine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note 2'-O-methyladenosine-3'-phosphate-N-[tris(GalNAc-alkyl)-ami dodecanoyl)]-4-hydroxyprolinol (Hyp-(GalNAc-alkyl)3)
atttgctatgttagacgatga

SEQ ID NO: 821 - RNA, 19 nt, synthetic construct
  source 1..19: mol_type = other RNA; note = Description of Artificial Sequence: Synthetic oligonucleotide
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = 2'-fluorouridine-3'-phosphate
  modified_base 8: mod_base = OTHER; note = 2'-fluoroguanosine-3'-phosphate
  modified_base 9: mod_base = OTHER; note = 2'-fluorouridine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note 2'-O-methyluridine-3'-phosphate-N-[tris(GalNAc-alkyl)-amido decanoyl)]-4-hydroxyprolinol (Hyp-(GalNAc-alkyl)3)
ttgctatgttagacgatgt

SEQ ID NO: 822 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluorouridine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note 2'-O-methyluridine-3'-phosphate-N-[tris(GalNAc-alkyl)-amido decanoyl)]-4-hydroxyprolinol (Hyp-(GalNAc-alkyl)3)
atttcctatgttagacgatgt

SEQ ID NO: 823 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluorouridine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note 2'-O-methyluridine-3'-phosphate-N-[tris(GalNAc-alkyl)-amido decanoyl)]-4-hydroxyprolinol (Hyp-(GalNAc-alkyl)3)
attagctatgttagacgatgt

SEQ ID NO: 824 - RNA, 21 nt, synthetic construct
  source 1..21: mol_type = other RNA; note = Description of Artificial Sequence: Synthetic oligonucleotide
  modified_base 1: mod_base = OTHER; note = 2'-O-methyladenosine-3'- phosphorothioate
  modified_base 2: mod_base = OTHER; note = 2'-O-methyluridine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluorouridine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note 2'-O-methyluridine-3'-phosphate-N-[tris(GalNAc-alkyl)-amido decanoyl)]-4-hydroxyprolinol (Hyp-(GalNAc-alkyl)3)
atatgctatgttagacgatgt

SEQ ID NO: 825 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-fluoroadenosine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methyladenosine-3'- phosphorothioate
  modified_base 23: mod_base = OTHER; note = 2'-O-methyladenosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aacaataaaaagaaggagcttaa

SEQ ID NO: 826 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 13: mod_base = OTHER; note = 2'-O-methyladenosine-3'-phosphate
  modified_base 15: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methyladenosine-3'- phosphorothioate
  modified_base 23: mod_base = OTHER; note = 2'-O-methyladenosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13: note = RNA
  misc_feature 14: note = DNA
  misc_feature 15: note = RNA
  misc_feature 16: note = DNA
  misc_feature 17..23: note = RNA
aacaataaaaagaaggagcttaa

SEQ ID NO: 827 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 13: mod_base = OTHER; note = 2'-O-methyladenosine-3'-phosphate
  modified_base 15: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13: note = RNA
  misc_feature 14: note = DNA
  misc_feature 15: note = RNA
  misc_feature 16: note = DNA
  misc_feature 17..23: note = RNA
aacaataaaaagaaggagcttgg

SEQ ID NO: 828 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyluridine-3'-phosphorothioate
  modified_base 2: mod_base = OTHER; note = 2'-deoxyadenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-fluoroadenosine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
tacaataaaaagaaggagcttgg

SEQ ID NO: 829 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyluridine-3'-phosphorothioate
  modified_base 2: mod_base = OTHER; note = 2'-deoxyadenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 13: mod_base = OTHER; note = 2'-O-methyladenosine-3'-phosphate
  modified_base 15: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13: note = RNA
  misc_feature 14: note = DNA
  misc_feature 15: note = RNA
  misc_feature 16: note = DNA
  misc_feature 17..23: note = RNA
tacaataaaaagaaggagcttgg

SEQ ID NO: 830 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-fluoroadenosine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aacaataaaaagaaggagcttct

SEQ ID NO: 831 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 13: mod_base = OTHER; note = 2'-O-methyladenosine-3'-phosphate
  modified_base 15: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13: note = RNA
  misc_feature 14: note = DNA
  misc_feature 15: note = RNA
  misc_feature 16: note = DNA
  misc_feature 17..23: note = RNA
aacaataaaaagaaggagcttct

SEQ ID NO: 832 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-fluoroadenosine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylcytidine-3'- phosphorothioate
  modified_base 20: mod_base = OTHER; note = 2'-O-methyluridine-3'-phosphorothioate
  modified_base 21: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..21: note = RNA
aacaataaaaagaaggagctt

SEQ ID NO: 833 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 13: mod_base = OTHER; note = 2'-O-methyladenosine-3'-phosphate
  modified_base 15: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylcytidine-3'- phosphorothioate
  modified_base 20: mod_base = OTHER; note = 2'-O-methyluridine-3'-phosphorothioate
  modified_base 21: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13: note = RNA
  misc_feature 14: note = DNA
  misc_feature 15: note = RNA
  misc_feature 16: note = DNA
  misc_feature 17..21: note = RNA
aacaataaaaagaaggagctt

SEQ ID NO: 834 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-fluoroadenosine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aacaataaaaagaaggtgcttct

SEQ ID NO: 835 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-fluoroadenosine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aacaataaaaagaaggaccttct

SEQ ID NO: 836 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-fluoroadenosine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aacaataaaaagaaggaggttct

SEQ ID NO: 837 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 6: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-fluoroadenosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyladenosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aaacaataaaaagaaggagctta

SEQ ID NO: 838 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 6: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 13: mod_base = OTHER; note = 2'-O-methylguanosine-3'-phosphate
  modified_base 15: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyladenosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13: note = RNA
  misc_feature 14: note = DNA
  misc_feature 15: note = RNA
  misc_feature 16: note = DNA
  misc_feature 17..23: note = RNA
aaacaataaaaagaaggagctta

SEQ ID NO: 839 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 6: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-fluoroadenosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aaacaataaaaagaaggagcttg

SEQ ID NO: 840 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 6: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 13: mod_base = OTHER; note = 2'-O-methylguanosine-3'-phosphate
  modified_base 15: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13: note = RNA
  misc_feature 14: note = DNA
  misc_feature 15: note = RNA
  misc_feature 16: note = DNA
  misc_feature 17..23: note = RNA
aaacaataaaaagaaggagcttg

SEQ ID NO: 841 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyluridine-3'-phosphorothioate
  modified_base 2: mod_base = OTHER; note = 2'-deoxyadenosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 6: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-fluoroadenosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
taacaataaaaagaaggagcttg

SEQ ID NO: 842 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyluridine-3'-phosphorothioate
  modified_base 2: mod_base = OTHER; note = 2'-deoxyadenosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 6: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 13: mod_base = OTHER; note = 2'-O-methylguanosine-3'-phosphate
  modified_base 15: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13: note = RNA
  misc_feature 14: note = DNA
  misc_feature 15: note = RNA
  misc_feature 16: note = DNA
  misc_feature 17..23: note = RNA
taacaataaaaagaaggagcttg

SEQ ID NO: 843 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 6: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-fluoroadenosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aaacaataaaaagaaggagctct

SEQ ID NO: 844 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 6: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 13: mod_base = OTHER; note = 2'-O-methylguanosine-3'-phosphate
  modified_base 15: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13: note = RNA
  misc_feature 14: note = DNA
  misc_feature 15: note = RNA
  misc_feature 16: note = DNA
  misc_feature 17..23: note = RNA
aaacaataaaaagaaggagctct

SEQ ID NO: 845 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 6: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-fluoroadenosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylguanosine-3'- phosphorothioate
  modified_base 20: mod_base = OTHER; note = 2'-O-methylcytidine-3'- phosphorothioate
  modified_base 21: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..21: note = RNA
aaacaataaaaagaaggagct

SEQ ID NO: 846 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 6: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 13: mod_base = OTHER; note = 2'-O-methylguanosine-3'-phosphate
  modified_base 15: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylguanosine-3'- phosphorothioate
  modified_base 20: mod_base = OTHER; note = 2'-O-methylcytidine-3'- phosphorothioate
  modified_base 21: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13: note = RNA
  misc_feature 14: note = DNA
  misc_feature 15: note = RNA
  misc_feature 16: note = DNA
  misc_feature 17..21: note = RNA
aaacaataaaaagaaggagct

SEQ ID NO: 847 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 6: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-fluoroadenosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aaacaataaaaagaagcagctct

SEQ ID NO: 848 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 6: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-fluoroadenosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aaacaataaaaagaaggtgctct

SEQ ID NO: 849 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 6: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-fluoroadenosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aaacaataaaaagaaggtcctct

SEQ ID NO: 850 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyluridine-3'-phosphorothioate
  modified_base 2: mod_base = OTHER; note = 2'-deoxythimidine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = Thymidine-glycol nucleic acid (GNA) S-Isomer
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-fluoroadenosine-3'-phosphate
  modified_base 15: mod_base = OTHER; note = 2'-O-methylcytidine-3'-phosphate
  modified_base 16: mod_base = OTHER; note = 2'-fluorouridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methylguanosine-3'- phosphorothioate
  modified_base 22: mod_base = OTHER; note = 2'-O-methylguanosine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6..23: note = RNA
tttaagtgaagttacttctgggt

SEQ ID NO: 851 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyluridine-3'-phosphorothioate
  modified_base 2: mod_base = OTHER; note = 2'-fluorouridine -3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = Thymidine-glycol nucleic acid (GNA) S-Isomer
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-fluoroadenosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methylguanosine-3'- phosphorothioate
  modified_base 22: mod_base = OTHER; note = 2'-O-methylguanosine-3'- phosphorothioate
  modified_base 23: mod_base = OTHER; note = 2'-O-methyluridine-3'-phosphate
  misc_feature 1..4: note = RNA
  misc_feature 5: note = DNA
  misc_feature 6..11: note = RNA
  misc_feature 12: note = DNA
  misc_feature 13..23: note = RNA
tttaagtgaagttacttctgggt

SEQ ID NO: 852 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyluridine-3'-phosphorothioate
  modified_base 2: mod_base = OTHER; note = 2'-fluorouridine -3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = Thymidine-glycol nucleic acid (GNA) S-Isomer
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 13: mod_base = OTHER; note = 2'-O-methyluridine-3'-phosphate
  modified_base 15: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methylguanosine-3'- phosphorothioate
  modified_base 22: mod_base = OTHER; note = 2'-O-methylguanosine-3'- phosphorothioate
  modified_base 23: mod_base = OTHER; note = 2'-O-methyluridine-3'-phosphate
  misc_feature 1..4: note = RNA
  misc_feature 5: note = DNA
  misc_feature 6..11: note = RNA
  misc_feature 12: note = DNA
  misc_feature 13: note = RNA
  misc_feature 14: note = DNA
  misc_feature 15: note = RNA
  misc_feature 16: note = DNA
  misc_feature 17..23: note = RNA
tttaagtgaagttacttctgggt

SEQ ID NO: 853 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyluridine-3'-phosphorothioate
  modified_base 2: mod_base = OTHER; note = 2'-deoxythimidine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = Thymidine-glycol nucleic acid (GNA) S-Isomer
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-fluoroadenosine-3'-phosphate
  modified_base 15: mod_base = OTHER; note = 2'-O-methylcytidine-3'-phosphate
  modified_base 16: mod_base = OTHER; note = 2'-fluorouridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methylguanosine-3'- phosphorothioate
  modified_base 22: mod_base = OTHER; note = 2'-O-methylcytidine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6..23: note = RNA
tttaagtgaagttacttctggct

SEQ ID NO: 854 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyluridine-3'-phosphorothioate
  modified_base 2: mod_base = OTHER; note = 2'-fluorouridine -3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = Thymidine-glycol nucleic acid (GNA) S-Isomer
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-fluoroadenosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methylguanosine-3'- phosphorothioate
  modified_base 22: mod_base = OTHER; note = 2'-O-methylcytidine-3'- phosphorothioate
  modified_base 23: mod_base = OTHER; note = 2'-O-methyluridine-3'-phosphate
  misc_feature 1..4: note = RNA
  misc_feature 5: note = DNA
  misc_feature 6..11: note = RNA
  misc_feature 12: note = DNA
  misc_feature 13..23: note = RNA
tttaagtgaagttacttctggct

SEQ ID NO: 855 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyluridine-3'-phosphorothioate
  modified_base 2: mod_base = OTHER; note = 2'-deoxythimidine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = Thymidine-glycol nucleic acid (GNA) S-Isomer
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-fluoroadenosine-3'-phosphate
  modified_base 15: mod_base = OTHER; note = 2'-O-methylcytidine-3'-phosphate
  modified_base 16: mod_base = OTHER; note = 2'-fluorouridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphorothioate
  modified_base 20: mod_base = OTHER; note = 2'-O-methylguanosine-3'- phosphorothioate
  modified_base 21: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6..21: note = RNA
tttaagtgaagttacttctgg

SEQ ID NO: 856 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyluridine-3'-phosphorothioate
  modified_base 2: mod_base = OTHER; note = 2'-fluorouridine -3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = Thymidine-glycol nucleic acid (GNA) S-Isomer
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-fluoroadenosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphorothioate
  modified_base 20: mod_base = OTHER; note = 2'-O-methylguanosine-3'- phosphorothioate
  modified_base 21: mod_base = OTHER; note = 2'-O-methylguanosine-3'-phosphate
  misc_feature 1..4: note = RNA
  misc_feature 5: note = DNA
  misc_feature 6..11: note = RNA
  misc_feature 12: note = DNA
  misc_feature 13..21: note = RNA
tttaagtgaagttacttctgg

SEQ ID NO: 857 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyluridine-3'-phosphorothioate
  modified_base 2: mod_base = OTHER; note = 2'-deoxythimidine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = Thymidine-glycol nucleic acid (GNA) S-Isomer
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-fluoroadenosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methylguanosine-3'- phosphorothioate
  modified_base 22: mod_base = OTHER; note = 2'-O-methylguanosine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6..11: note = RNA
  misc_feature 12: note = DNA
  misc_feature 13..23: note = RNA
tttaagtgaagttacttctgggt

SEQ ID NO: 858 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyluridine-3'-phosphorothioate
  modified_base 2: mod_base = OTHER; note = 2'-deoxythimidine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = Thymidine-glycol nucleic acid (GNA) S-Isomer
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-fluoroadenosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphorothioate
  modified_base 20: mod_base = OTHER; note = 2'-O-methylguanosine-3'- phosphorothioate
  modified_base 21: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6..11: note = RNA
  misc_feature 12: note = DNA
  misc_feature 13..21: note = RNA
tttaagtgaagttacttctgg

SEQ ID NO: 859 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyluridine-3'-phosphorothioate
  modified_base 2: mod_base = OTHER; note = 2'-deoxythimidine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = uridine-2'-phosphate
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-fluoroadenosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methylguanosine-3'- phosphorothioate
  modified_base 22: mod_base = OTHER; note = 2'-O-methylcytidine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6..11: note = RNA
  misc_feature 12: note = DNA
  misc_feature 13..23: note = RNA
tttaagtgaagttacttctggct

SEQ ID NO: 860 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyluridine-3'-phosphorothioate
  modified_base 2: mod_base = OTHER; note = 2'-fluorouridine -3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = Thymidine-glycol nucleic acid (GNA) S-Isomer
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-fluoroadenosine-3'-phosphate
  modified_base 15: mod_base = OTHER; note = 2'-O-methylcytidine-3'-phosphate
  modified_base 16: mod_base = OTHER; note = 2'-fluorouridine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methylguanosine-3'- phosphorothioate
  modified_base 22: mod_base = OTHER; note = 2'-O-methylguanosine-3'- phosphorothioate
  modified_base 23: mod_base = OTHER; note = 2'-O-methyluridine-3'-phosphate
  misc_feature 1..4: note = RNA
  misc_feature 5: note = DNA
  misc_feature 6..23: note = RNA
tttaagtgaagttactactgggt

SEQ ID NO: 861 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyluridine-3'-phosphorothioate
  modified_base 2: mod_base = OTHER; note = 2'-fluorouridine -3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = Thymidine-glycol nucleic acid (GNA) S-Isomer
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-fluoroadenosine-3'-phosphate
  modified_base 15: mod_base = OTHER; note = 2'-O-methylcytidine-3'-phosphate
  modified_base 16: mod_base = OTHER; note = 2'-fluorouridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methylguanosine-3'- phosphorothioate
  modified_base 22: mod_base = OTHER; note = 2'-O-methylguanosine-3'- phosphorothioate
  modified_base 23: mod_base = OTHER; note = 2'-O-methyluridine-3'-phosphate
  misc_feature 1..4: note = RNA
  misc_feature 5: note = DNA
  misc_feature 6..23: note = RNA
tttaagtgaagttacttgtgggt

SEQ ID NO: 862 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyluridine-3'-phosphorothioate
  modified_base 2: mod_base = OTHER; note = 2'-fluorouridine -3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = Thymidine-glycol nucleic acid (GNA) S-Isomer
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-fluoroadenosine-3'-phosphate
  modified_base 15: mod_base = OTHER; note = 2'-O-methylcytidine-3'-phosphate
  modified_base 16: mod_base = OTHER; note = 2'-fluorouridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methylguanosine-3'- phosphorothioate
  modified_base 22: mod_base = OTHER; note = 2'-O-methylguanosine-3'- phosphorothioate
  modified_base 23: mod_base = OTHER; note = 2'-O-methyluridine-3'-phosphate
  misc_feature 1..4: note = RNA
  misc_feature 5: note = DNA
  misc_feature 6..23: note = RNA
tttaagtgaagttacttcagggt

SEQ ID NO: 863 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = guanosine-2'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-fluorouridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyladenosine-3'- phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6..23: note = RNA
aaaggagcttaattgtgaacatt

SEQ ID NO: 864 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = guanosine-2'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyladenosine-3'- phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6..11: note = RNA
  misc_feature 12: note = DNA
  misc_feature 13..23: note = RNA
aaaggagcttaattgtgaacatt

SEQ ID NO: 865 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = guanosine-2'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-fluorouridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyladenosine-3'- phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6..11: note = RNA
  misc_feature 12: note = DNA
  misc_feature 13..23: note = RNA
aaaggagcttaattgtgaacatt

SEQ ID NO: 866 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = guanosine-2'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 13: mod_base = OTHER; note = 2'-O-methyluridine-3'-phosphate
  modified_base 15: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyladenosine-3'- phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6..11: note = RNA
  misc_feature 12: note = DNA
  misc_feature 13: note = RNA
  misc_feature 14: note = DNA
  misc_feature 15: note = RNA
  misc_feature 16: note = DNA
  misc_feature 17..23: note = RNA
aaaggagcttaattgtgaacatt

SEQ ID NO: 867 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = guanosine-2'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 13: mod_base = OTHER; note = 2'-O-methyluridine-3'-phosphate
  modified_base 15: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyladenosine-3'- phosphorothioate
  modified_base 22: mod_base = OTHER; note = 2'-O-methylcytidine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6..11: note = RNA
  misc_feature 12: note = DNA
  misc_feature 13: note = RNA
  misc_feature 14: note = DNA
  misc_feature 15: note = RNA
  misc_feature 16: note = DNA
  misc_feature 17..23: note = RNA
aaaggagcttaattgtgaacact

SEQ ID NO: 868 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = guanosine-2'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-fluorouridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyladenosine-3'- phosphorothioate
  modified_base 22: mod_base = OTHER; note = 2'-O-methylguanosine-3'- phosphorothioate
  modified_base 23: mod_base = OTHER; note = 2'-O-methylguanosine-3'-phosphate
  misc_feature 1..4: note = RNA
  misc_feature 5: note = DNA
  misc_feature 6..23: note = RNA
aaaggagcttaattgtgaacagg

SEQ ID NO: 869 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = guanosine-2'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-fluorouridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyladenosine-3'- phosphorothioate
  modified_base 22: mod_base = OTHER; note = 2'-O-methylguanosine-3'- phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6..23: note = RNA
aaaggagcttaattgtgaacagg

SEQ ID NO: 870 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = guanosine-2'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyladenosine-3'- phosphorothioate
  modified_base 22: mod_base = OTHER; note = 2'-O-methylguanosine-3'- phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6..11: note = RNA
  misc_feature 12: note = DNA
  misc_feature 13..23: note = RNA
aaaggagcttaattgtgaacagg

SEQ ID NO: 871 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = guanosine-2'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-fluorouridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'- phosphorothioate
  modified_base 20: mod_base = OTHER; note = 2'-O-methylcytidine-3'- phosphorothioate
  modified_base 21: mod_base = OTHER; note = 2'-O-methylguanosine-3'-phosphate
  misc_feature 1..4: note = RNA
  misc_feature 5: note = DNA
  misc_feature 6..21: note = RNA
aaaggagcttaattgtgaacg

SEQ ID NO: 872 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = guanosine-2'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-fluorouridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'- phosphorothioate
  modified_base 20: mod_base = OTHER; note = 2'-O-methylcytidine-3'- phosphorothioate
  modified_base 21: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6..21: note = RNA
aaaggagcttaattgtgaacg

SEQ ID NO: 873 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = guanosine-2'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'- phosphorothioate
  modified_base 20: mod_base = OTHER; note = 2'-O-methylcytidine-3'- phosphorothioate
  modified_base 21: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6..11: note = RNA
  misc_feature 12: note = DNA
  misc_feature 13..21: note = RNA
aaaggagcttaattgtgaacg

SEQ ID NO: 874 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = guanosine-2'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-fluorouridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyladenosine-3'- phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6..23: note = RNA
aaaggagcttaattgtcaacatt

SEQ ID NO: 875 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = guanosine-2'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-fluorouridine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyladenosine-3'- phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6..23: note = RNA
aaaggagcttaattgtgtacatt

SEQ ID NO: 876 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = guanosine-2'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-fluorouridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyladenosine-3'- phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6..23: note = RNA
aaaggagcttaattgtgatcatt

SEQ ID NO: 877 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methylguanosine-3'- phosphorothioate
  modified_base 22: mod_base = OTHER; note = 2'-O-methyladenosine-3'- phosphorothioate
  modified_base 23: mod_base = OTHER; note = 2'-O-methyladenosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aaaagaaggagcttaattgtgaa

SEQ ID NO: 878 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 13: mod_base = OTHER; note = 2'-O-methyluridine-3'-phosphate
  modified_base 15: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methylguanosine-3'- phosphorothioate
  modified_base 22: mod_base = OTHER; note = 2'-O-methyladenosine-3'- phosphorothioate
  modified_base 23: mod_base = OTHER; note = 2'-O-methyladenosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13: note = RNA
  misc_feature 14: note = DNA
  misc_feature 15: note = RNA
  misc_feature 16: note = DNA
  misc_feature 17..23: note = RNA
aaaagaaggagcttaattgtgaa

SEQ ID NO: 879 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methylguanosine-3'- phosphorothioate
  modified_base 22: mod_base = OTHER; note = 2'-O-methylguanosine-3'- phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aaaagaaggagcttaattgtggg

SEQ ID NO: 880 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyluridine-3'-phosphorothioate
  modified_base 2: mod_base = OTHER; note = 2'-deoxyadenosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methylguanosine-3'- phosphorothioate
  modified_base 22: mod_base = OTHER; note = 2'-O-methylguanosine-3'- phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
taaagaaggagcttaattgtggg

SEQ ID NO: 881 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 13: mod_base = OTHER; note = 2'-O-methyluridine-3'-phosphate
  modified_base 15: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methylguanosine-3'- phosphorothioate
  modified_base 22: mod_base = OTHER; note = 2'-O-methylguanosine-3'- phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13: note = RNA
  misc_feature 14: note = DNA
  misc_feature 15: note = RNA
  misc_feature 16: note = DNA
  misc_feature 17..23: note = RNA
aaaagaaggagcttaattgtggg

SEQ ID NO: 882 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methylguanosine-3'- phosphorothioate
  modified_base 22: mod_base = OTHER; note = 2'-O-methylcytidine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aaaagaaggagcttaattgtgct

SEQ ID NO: 883 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyluridine-3'-phosphorothioate
  modified_base 2: mod_base = OTHER; note = 2'-deoxyadenosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methylguanosine-3'- phosphorothioate
  modified_base 22: mod_base = OTHER; note = 2'-O-methylcytidine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
taaagaaggagcttaattgtgct

SEQ ID NO: 884 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 13: mod_base = OTHER; note = 2'-O-methyluridine-3'-phosphate
  modified_base 15: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methylguanosine-3'- phosphorothioate
  modified_base 22: mod_base = OTHER; note = 2'-O-methylcytidine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13: note = RNA
  misc_feature 14: note = DNA
  misc_feature 15: note = RNA
  misc_feature 16: note = DNA
  misc_feature 17..23: note = RNA
aaaagaaggagcttaattgtgct

SEQ ID NO: 885 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'- phosphorothioate
  modified_base 20: mod_base = OTHER; note = 2'-O-methyluridine-3'-phosphorothioate
  modified_base 21: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..21: note = RNA
aaaagaaggagcttaattgtg

SEQ ID NO: 886 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 13: mod_base = OTHER; note = 2'-O-methyluridine-3'-phosphate
  modified_base 15: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'- phosphorothioate
  modified_base 20: mod_base = OTHER; note = 2'-O-methyluridine-3'-phosphorothioate
  modified_base 21: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13: note = RNA
  misc_feature 14: note = DNA
  misc_feature 15: note = RNA
  misc_feature 16: note = DNA
  misc_feature 17..21: note = RNA
aaaagaaggagcttaattgtg

SEQ ID NO: 887 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methylguanosine-3'- phosphorothioate
  modified_base 22: mod_base = OTHER; note = 2'-O-methylcytidine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aaaagaaggagcttaaatgtgct

SEQ ID NO: 888 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methylguanosine-3'- phosphorothioate
  modified_base 22: mod_base = OTHER; note = 2'-O-methylcytidine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aaaagaaggagcttaatagtgct

SEQ ID NO: 889 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylguanosine-3'- phosphorothioate
  modified_base 22: mod_base = OTHER; note = 2'-O-methylcytidine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aaaagaaggagcttaattctgct

SEQ ID NO: 890 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = adenosine-2'-phosphate
  modified_base 8: mod_base = OTHER; note = 2'-O-methylguanosine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methyladenosine-3'-phosphate
  modified_base 16: mod_base = OTHER; note = 2'-fluoroadenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methylguanosine-3'- phosphorothioate
  modified_base 22: mod_base = OTHER; note = 2'-O-methylcytidine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6..11: note = RNA
  misc_feature 12: note = DNA
  misc_feature 13..23: note = RNA
aaaagaaggagcttaattgtgct

SEQ ID NO: 891 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-deoxythimidine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-fluoroguanosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
ataaaaagaaggagcttaattgt

SEQ ID NO: 892 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyluridine-3'-phosphorothioate
  modified_base 2: mod_base = OTHER; note = 2'-deoxythimidine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-fluoroguanosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
ttaaaaagaaggagcttaattgt

SEQ ID NO: 893 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-deoxythimidine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 13: mod_base = OTHER; note = 2'-O-methyladenosine-3'-phosphate
  modified_base 15: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13: note = RNA
  misc_feature 14: note = DNA
  misc_feature 15: note = RNA
  misc_feature 16: note = DNA
  misc_feature 17..23: note = RNA
ataaaaagaaggagcttaattgt

SEQ ID NO: 894 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyluridine-3'-phosphorothioate
  modified_base 2: mod_base = OTHER; note = 2'-deoxythimidine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 13: mod_base = OTHER; note = 2'-O-methyladenosine-3'-phosphate
  modified_base 15: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13: note = RNA
  misc_feature 14: note = DNA
  misc_feature 15: note = RNA
  misc_feature 16: note = DNA
  misc_feature 17..23: note = RNA
ttaaaaagaaggagcttaattgt

SEQ ID NO: 895 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-deoxythimidine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = adenosine-2'-phosphate
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-fluoroguanosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6..11: note = RNA
  misc_feature 12: note = DNA
  misc_feature 13..23: note = RNA
ataaaaagaaggagcttaattgt

SEQ ID NO: 896 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-deoxythimidine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = adenosine-2'-phosphate
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-fluoroguanosine-3'-phosphate
  modified_base 15: mod_base = OTHER; note = 2'-O-methylcytidine-3'-phosphate
  modified_base 16: mod_base = OTHER; note = 2'-fluorouridine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6..11: note = RNA
  misc_feature 12: note = DNA
  misc_feature 13..23: note = RNA
ataaaaagaaggagcttaattgt

SEQ ID NO: 897 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-deoxythimidine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-fluoroguanosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyladenosine-3'- phosphorothioate
  modified_base 20: mod_base = OTHER; note = 2'-O-methyluridine-3'-phosphorothioate
  modified_base 21: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..21: note = RNA
ataaaaagaaggagcttaatt

SEQ ID NO: 898 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-deoxythimidine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 13: mod_base = OTHER; note = 2'-O-methyladenosine-3'-phosphate
  modified_base 15: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyladenosine-3'- phosphorothioate
  modified_base 20: mod_base = OTHER; note = 2'-O-methyluridine-3'-phosphorothioate
  modified_base 21: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13: note = RNA
  misc_feature 14: note = DNA
  misc_feature 15: note = RNA
  misc_feature 16: note = DNA
  misc_feature 17..21: note = RNA
ataaaaagaaggagcttaatt

SEQ ID NO: 899 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-deoxythimidine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = adenosine-2'-phosphate
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-fluoroguanosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyladenosine-3'- phosphorothioate
  modified_base 20: mod_base = OTHER; note = 2'-O-methyluridine-3'-phosphorothioate
  modified_base 21: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6..11: note = RNA
  misc_feature 12: note = DNA
  misc_feature 13..21: note = RNA
ataaaaagaaggagcttaatt

SEQ ID NO: 900 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-deoxythimidine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = adenosine-2'-phosphate
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 13: mod_base = OTHER; note = 2'-O-methyladenosine-3'-phosphate
  modified_base 15: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyladenosine-3'- phosphorothioate
  modified_base 20: mod_base = OTHER; note = 2'-O-methyluridine-3'-phosphorothioate
  modified_base 21: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6..11: note = RNA
  misc_feature 12: note = DNA
  misc_feature 13: note = RNA
  misc_feature 14: note = DNA
  misc_feature 15: note = RNA
  misc_feature 16: note = DNA
  misc_feature 17..21: note = RNA
ataaaaagaaggagcttaatt

SEQ ID NO: 901 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-deoxythimidine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-fluoroguanosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
ataaaaagaaggagctaaattgt

SEQ ID NO: 902 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-deoxythimidine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-fluoroguanosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
ataaaaagaaggagctttattgt

SEQ ID NO: 903 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-deoxythimidine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-fluoroguanosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
ataaaaagaaggagcttatttgt

SEQ ID NO: 904 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-fluorouridine -3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = adenosine-2'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-fluoroadenosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyladenosine-3'- phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
  misc_feature 1..4: note = RNA
  misc_feature 5: note = DNA
  misc_feature 6..23: note = RNA
atcataaaaagactgatcaaatg

SEQ ID NO: 905 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyluridine-3'-phosphorothioate
  modified_base 2: mod_base = OTHER; note = 2'-fluorouridine -3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = adenosine-2'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-fluoroadenosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyladenosine-3'- phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
  misc_feature 1..4: note = RNA
  misc_feature 5: note = DNA
  misc_feature 6..23: note = RNA
ttcataaaaagactgatcaaatg

SEQ ID NO: 906 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-deoxythimidine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = adenosine-2'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-fluoroadenosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyladenosine-3'- phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6..23: note = RNA
atcataaaaagactgatcaaatg

SEQ ID NO: 907 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-deoxythimidine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = adenosine-2'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyladenosine-3'- phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..15: note = RNA
  misc_feature 16: note = DNA
  misc_feature 17..23: note = RNA
atcataaaaagactgatcaaatg

SEQ ID NO: 908 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-deoxythimidine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = adenosine-2'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-fluoroadenosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyladenosine-3'- phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6..11: note = RNA
  misc_feature 12: note = DNA
  misc_feature 13..23: note = RNA
atcataaaaagactgatcaaatg

SEQ ID NO: 909 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyluridine-3'-phosphorothioate
  modified_base 2: mod_base = OTHER; note = 2'-deoxythimidine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = adenosine-2'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-fluoroadenosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyladenosine-3'- phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6..11: note = RNA
  misc_feature 12: note = DNA
  misc_feature 13..23: note = RNA
ttcataaaaagactgatcaaatg

SEQ ID NO: 910 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-deoxythimidine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = adenosine-2'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyladenosine-3'- phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..11: note = RNA
  misc_feature 12: note = DNA
  misc_feature 13..15: note = RNA
  misc_feature 16: note = DNA
  misc_feature 17..23: note = RNA
atcataaaaagactgatcaaatg

SEQ ID NO: 911 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-deoxythimidine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = adenosine-2'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 13: mod_base = OTHER; note = 2'-O-methylcytidine-3'-phosphate
  modified_base 15: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyladenosine-3'- phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..11: note = RNA
  misc_feature 12: note = DNA
  misc_feature 13: note = RNA
  misc_feature 14: note = DNA
  misc_feature 15: note = RNA
  misc_feature 16: note = DNA
  misc_feature 17..23: note = RNA
atcataaaaagactgatcaaatg

SEQ ID NO: 912 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-deoxythimidine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = adenosine-2'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyladenosine-3'- phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6..11: note = RNA
  misc_feature 12: note = DNA
  misc_feature 13..23: note = RNA
atcataaaaagactgatcaaatg

SEQ ID NO: 913 - DNA, 22 bp, synthetic construct
  source 1..22: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-deoxythimidine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = adenosine-2'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyladenosine-3'- phosphorothioate
  modified_base 21: mod_base = OTHER; note = 2'-O-methylcytidine-3'- phosphorothioate
  modified_base 22: mod_base = OTHER; note = 2'-O-methyluridine-3'-phosphate
  misc_feature 1: note = RNA
  misc_feature 2: note = DNA
  misc_feature 3..11: note = RNA
  misc_feature 12: note = DNA
  misc_feature 13..22: note = RNA
atcataaaaagactgatcaact

SEQ ID NO: 914 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-deoxythimidine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = adenosine-2'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-fluoroadenosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyladenosine-3'- phosphorothioate
  modified_base 22: mod_base = OTHER; note = 2'-O-methylcytidine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6..11: note = RNA
  misc_feature 12: note = DNA
  misc_feature 13..23: note = RNA
atcataaaaagactgatcaaact

SEQ ID NO: 915 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-deoxythimidine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = adenosine-2'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-fluoroadenosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyladenosine-3'- phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6..11: note = RNA
  misc_feature 12: note = DNA
  misc_feature 13..23: note = RNA
atcataaaaagactgaacaaatg

SEQ ID NO: 916 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-deoxythimidine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = adenosine-2'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-fluoroadenosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyladenosine-3'- phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6..11: note = RNA
  misc_feature 12: note = DNA
  misc_feature 13..23: note = RNA
atcataaaaagactgatgaaatg

SEQ ID NO: 917 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-deoxythimidine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = adenosine-2'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-fluoroadenosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyladenosine-3'- phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6..11: note = RNA
  misc_feature 12: note = DNA
  misc_feature 13..23: note = RNA
atcataaaaagactgatctaatg

SEQ ID NO: 918 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-deoxythimidine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyladenosine-3'- phosphorothioate
  modified_base 22: mod_base = OTHER; note = 2'-O-methylcytidine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
atcataaaaagactgatcaaact

SEQ ID NO: 919 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyluridine-3'-phosphorothioate
  modified_base 2: mod_base = OTHER; note = 2'-deoxythimidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = guanosine-2'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methyladenosine-3'-phosphate
  modified_base 16: mod_base = OTHER; note = 2'-fluorocytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylguanosine-3'- phosphorothioate
  modified_base 22: mod_base = OTHER; note = 2'-O-methylguanosine-3'- phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6..23: note = RNA
ttttaagtgaagttacttctggg

SEQ ID NO: 920 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyluridine-3'-phosphorothioate
  modified_base 2: mod_base = OTHER; note = 2'-deoxythimidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = guanosine-2'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methyladenosine-3'-phosphate
  modified_base 16: mod_base = OTHER; note = 2'-fluorocytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylguanosine-3'- phosphorothioate
  modified_base 22: mod_base = OTHER; note = 2'-O-methylguanosine-3'- phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6..11: note = RNA
  misc_feature 12: note = DNA
  misc_feature 13..23: note = RNA
ttttaagtgaagttacttctggg

SEQ ID NO: 921 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyluridine-3'-phosphorothioate
  modified_base 2: mod_base = OTHER; note = 2'-deoxythimidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = guanosine-2'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylguanosine-3'- phosphorothioate
  modified_base 22: mod_base = OTHER; note = 2'-O-methylguanosine-3'- phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6..11: note = RNA
  misc_feature 12: note = DNA
  misc_feature 13..23: note = RNA
ttttaagtgaagttacttctggg

SEQ ID NO: 922 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyluridine-3'-phosphorothioate
  modified_base 2: mod_base = OTHER; note = 2'-deoxythimidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = guanosine-2'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 13: mod_base = OTHER; note = 2'-O-methyluridine-3'-phosphate
  modified_base 15: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylguanosine-3'- phosphorothioate
  modified_base 22: mod_base = OTHER; note = 2'-O-methylguanosine-3'- phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6..11: note = RNA
  misc_feature 12: note = DNA
  misc_feature 13: note = RNA
  misc_feature 14: note = DNA
  misc_feature 15: note = RNA
  misc_feature 16: note = DNA
  misc_feature 17..23: note = RNA
ttttaagtgaagttacttctggg

SEQ ID NO: 923 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyluridine-3'-phosphorothioate
  modified_base 2: mod_base = OTHER; note = 2'-deoxythimidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = guanosine-2'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'- phosphorothioate
  modified_base 20: mod_base = OTHER; note = 2'-O-methyluridine-3'-phosphorothioate
  modified_base 21: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6..11: note = RNA
  misc_feature 12: note = DNA
  misc_feature 13..21: note = RNA
ttttaagtgaagttacttctg

SEQ ID NO: 924 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyluridine-3'-phosphorothioate
  modified_base 2: mod_base = OTHER; note = 2'-deoxythimidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = guanosine-2'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = uridine-2'-phosphate
  modified_base 15: mod_base = OTHER; note = 2'-O-methyladenosine-3'-phosphate
  modified_base 16: mod_base = OTHER; note = 2'-fluorocytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylguanosine-3'- phosphorothioate
  modified_base 22: mod_base = OTHER; note = 2'-O-methylguanosine-3'- phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6..11: note = RNA
  misc_feature 12: note = DNA
  misc_feature 13..23: note = RNA
ttttaagtgaagttacttctggg

SEQ ID NO: 925 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyluridine-3'-phosphorothioate
  modified_base 2: mod_base = OTHER; note = 2'-deoxythimidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = guanosine-2'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = adenosine-2'-phosphate
  modified_base 16: mod_base = OTHER; note = 2'-fluorocytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylguanosine-3'- phosphorothioate
  modified_base 22: mod_base = OTHER; note = 2'-O-methylguanosine-3'- phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6..11: note = RNA
  misc_feature 12: note = DNA
  misc_feature 13..23: note = RNA
ttttaagtgaagttacttctggg

SEQ ID NO: 926 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyluridine-3'-phosphorothioate
  modified_base 2: mod_base = OTHER; note = 2'-deoxythimidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = guanosine-2'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methyladenosine-3'-phosphate
  modified_base 16: mod_base = OTHER; note = cytidine-2'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylguanosine-3'- phosphorothioate
  modified_base 22: mod_base = OTHER; note = 2'-O-methylguanosine-3'- phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6..11: note = RNA
  misc_feature 12: note = DNA
  misc_feature 13..23: note = RNA
ttttaagtgaagttacttctggg

SEQ ID NO: 927 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyluridine-3'-phosphorothioate
  modified_base 2: mod_base = OTHER; note = 2'-deoxythimidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = guanosine-2'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methyladenosine-3'-phosphate
  modified_base 16: mod_base = OTHER; note = 2'-fluorocytidine-3'-phosphate
  modified_base 17: mod_base = OTHER; note = uridine-2'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylguanosine-3'- phosphorothioate
  modified_base 22: mod_base = OTHER; note = 2'-O-methylguanosine-3'- phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6..11: note = RNA
  misc_feature 12: note = DNA
  misc_feature 13..23: note = RNA
ttttaagtgaagttacttctggg

SEQ ID NO: 928 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyluridine-3'-phosphorothioate
  modified_base 2: mod_base = OTHER; note = 2'-deoxythimidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylguanosine-3'- phosphorothioate
  modified_base 22: mod_base = OTHER; note = 2'-O-methylguanosine-3'- phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
ttttaagtgaagttacttctggg

SEQ ID NO: 929 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = Adenosine-glycol nucleic acid (GNA) S-Isomer
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-fluorocytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  modified_base 23: mod_base = OTHER; note = 2'-O-methyluridine-3'-phosphate
  misc_feature 1..4: note = RNA
  misc_feature 5: note = DNA
  misc_feature 6..23: note = RNA
aaagtgaagttacttctgggtgt

SEQ ID NO: 930 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = adenosine-2'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-fluorocytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  modified_base 23: mod_base = OTHER; note = 2'-O-methyluridine-3'-phosphate
  misc_feature 1..4: note = RNA
  misc_feature 5: note = DNA
  misc_feature 6..23: note = RNA
aaagtgaagttacttctgggtgt

SEQ ID NO: 931 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyluridine-3'-phosphorothioate
  modified_base 2: mod_base = OTHER; note = 2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = Adenosine-glycol nucleic acid (GNA) S-Isomer
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-fluorocytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  modified_base 23: mod_base = OTHER; note = 2'-O-methyluridine-3'-phosphate
  misc_feature 1..4: note = RNA
  misc_feature 5: note = DNA
  misc_feature 6..23: note = RNA
taagtgaagttacttctgggtgt

SEQ ID NO: 932 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyluridine-3'-phosphorothioate
  modified_base 2: mod_base = OTHER; note = 2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = adenosine-2'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-fluorocytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  modified_base 23: mod_base = OTHER; note = 2'-O-methyluridine-3'-phosphate
  misc_feature 1..4: note = RNA
  misc_feature 5: note = DNA
  misc_feature 6..23: note = RNA
taagtgaagttacttctgggtgt

SEQ ID NO: 933 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 6: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-fluorocytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  modified_base 23: mod_base = OTHER; note = 2'-O-methyluridine-3'-phosphate
  misc_feature 1..4: note = RNA
  misc_feature 5: note = DNA
  misc_feature 6: note = RNA
  misc_feature 7: note = DNA
  misc_feature 8..23: note = RNA
aaagtaaagttacttctgggtgt

SEQ ID NO: 934 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = Adenosine-glycol nucleic acid (GNA) S-Isomer
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-fluorocytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6..23: note = RNA
aaagtgaagttacttctgggtgt

SEQ ID NO: 935 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = adenosine-2'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-fluorocytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6..23: note = RNA
aaagtgaagttacttctgggtgt

SEQ ID NO: 936 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = Adenosine-glycol nucleic acid (GNA) S-Isomer
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-fluorocytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6..23: note = RNA
aaagtgaagttacttctgggtct

SEQ ID NO: 937 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = adenosine-2'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-fluorocytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6..23: note = RNA
aaagtgaagttacttctgggtct

SEQ ID NO: 938 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = adenosine-2'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-fluorocytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  modified_base 23: mod_base = OTHER; note = 2'-O-methyluridine-3'-phosphate
  misc_feature 1..4: note = RNA
  misc_feature 5: note = DNA
  misc_feature 6..23: note = RNA
aaagtgaagttacttctgggtct

SEQ ID NO: 939 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = adenosine-2'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-fluorocytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6..11: note = RNA
  misc_feature 12: note = DNA
  misc_feature 13..23: note = RNA
aaagtgaagttacttctgggtct

SEQ ID NO: 940 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = Adenosine-glycol nucleic acid (GNA) S-Isomer
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-fluorocytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'- phosphorothioate
  modified_base 20: mod_base = OTHER; note = 2'-O-methylguanosine-3'- phosphorothioate
  modified_base 21: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6..21: note = RNA
aaagtgaagttacttctgggt

SEQ ID NO: 941 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = adenosine-2'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-fluorocytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'- phosphorothioate
  modified_base 20: mod_base = OTHER; note = 2'-O-methylguanosine-3'- phosphorothioate
  modified_base 21: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6..21: note = RNA
aaagtgaagttacttctgggt

SEQ ID NO: 942 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = adenosine-2'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-fluorocytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'- phosphorothioate
  modified_base 20: mod_base = OTHER; note = 2'-O-methylguanosine-3'- phosphorothioate
  modified_base 21: mod_base = OTHER; note = 2'-O-methyluridine-3'-phosphate
  misc_feature 1..4: note = RNA
  misc_feature 5: note = DNA
  misc_feature 6..21: note = RNA
aaagtgaagttacttctgggt

SEQ ID NO: 943 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = adenosine-2'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-fluorocytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'- phosphorothioate
  modified_base 20: mod_base = OTHER; note = 2'-O-methylguanosine-3'- phosphorothioate
  modified_base 21: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6..11: note = RNA
  misc_feature 12: note = DNA
  misc_feature 13..21: note = RNA
aaagtgaagttacttctgggt

SEQ ID NO: 944 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = adenosine-2'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-fluorocytidine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6..23: note = RNA
aaagtgaagttacttcagggtgt

SEQ ID NO: 945 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = adenosine-2'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-fluorocytidine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6..23: note = RNA
aaagtgaagttacttctcggtgt

SEQ ID NO: 946 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = adenosine-2'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-fluorocytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6..23: note = RNA
aaagtgaagttacttctgcgtgt

SEQ ID NO: 947 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-fluorouridine -3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = Adenosine-glycol nucleic acid (GNA) S-Isomer
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-fluoroadenosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  modified_base 23: mod_base = OTHER; note = 2'-O-methylguanosine-3'-phosphate
  misc_feature 1..4: note = RNA
  misc_feature 5: note = DNA
  misc_feature 6..23: note = RNA
attttaagtgaagttacttctgg

SEQ ID NO: 948 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-fluorouridine -3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = adenosine-2'-phosphate
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-fluoroadenosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  modified_base 23: mod_base = OTHER; note = 2'-O-methylguanosine-3'-phosphate
  misc_feature 1..4: note = RNA
  misc_feature 5: note = DNA
  misc_feature 6..23: note = RNA
attttaagtgaagttacttctgg

SEQ ID NO: 949 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-fluorouridine -3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = Adenosine-glycol nucleic acid (GNA) S-Isomer
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-fluoroadenosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  modified_base 23: mod_base = OTHER; note = 2'-O-methylguanosine-3'-phosphate
  misc_feature 1..4: note = RNA
  misc_feature 5: note = DNA
  misc_feature 6..11: note = RNA
  misc_feature 12: note = DNA
  misc_feature 13..23: note = RNA
attttaagtgaagttacttctgg

SEQ ID NO: 950 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-fluorouridine -3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = adenosine-2'-phosphate
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-fluoroadenosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  modified_base 23: mod_base = OTHER; note = 2'-O-methylguanosine-3'-phosphate
  misc_feature 1..4: note = RNA
  misc_feature 5: note = DNA
  misc_feature 6..11: note = RNA
  misc_feature 12: note = DNA
  misc_feature 13..23: note = RNA
attttaagtgaagttacttctgg

SEQ ID NO: 951 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyluridine-3'-phosphorothioate
  modified_base 2: mod_base = OTHER; note = 2'-fluorouridine -3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = Adenosine-glycol nucleic acid (GNA) S-Isomer
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-fluoroadenosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  modified_base 23: mod_base = OTHER; note = 2'-O-methylguanosine-3'-phosphate
  misc_feature 1..4: note = RNA
  misc_feature 5: note = DNA
  misc_feature 6..11: note = RNA
  misc_feature 12: note = DNA
  misc_feature 13..23: note = RNA
tttttaagtgaagttacttctgg

SEQ ID NO: 952 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyluridine-3'-phosphorothioate
  modified_base 2: mod_base = OTHER; note = 2'-fluorouridine -3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = adenosine-2'-phosphate
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-fluoroadenosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  modified_base 23: mod_base = OTHER; note = 2'-O-methylguanosine-3'-phosphate
  misc_feature 1..4: note = RNA
  misc_feature 5: note = DNA
  misc_feature 6..11: note = RNA
  misc_feature 12: note = DNA
  misc_feature 13..23: note = RNA
tttttaagtgaagttacttctgg

SEQ ID NO: 953 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-fluorouridine -3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = Adenosine-glycol nucleic acid (GNA) S-Isomer
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  modified_base 23: mod_base = OTHER; note = 2'-O-methylguanosine-3'-phosphate
  misc_feature 1..4: note = RNA
  misc_feature 5: note = DNA
  misc_feature 6..11: note = RNA
  misc_feature 12: note = DNA
  misc_feature 13..23: note = RNA
attttaagtgaagttacttctgg

SEQ ID NO: 954 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-fluorouridine -3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = adenosine-2'-phosphate
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  modified_base 23: mod_base = OTHER; note = 2'-O-methylguanosine-3'-phosphate
  misc_feature 1..4: note = RNA
  misc_feature 5: note = DNA
  misc_feature 6..11: note = RNA
  misc_feature 12: note = DNA
  misc_feature 13..23: note = RNA
attttaagtgaagttacttctgg

SEQ ID NO: 955 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-deoxythimidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = Adenosine-glycol nucleic acid (GNA) S-Isomer
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-fluoroadenosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6..11: note = RNA
  misc_feature 12: note = DNA
  misc_feature 13..23: note = RNA
attttaagtgaagttacttctgg

SEQ ID NO: 956 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-deoxythimidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = adenosine-2'-phosphate
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-fluoroadenosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6..11: note = RNA
  misc_feature 12: note = DNA
  misc_feature 13..23: note = RNA
attttaagtgaagttacttctgg

SEQ ID NO: 957 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-deoxythimidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = Adenosine-glycol nucleic acid (GNA) S-Isomer
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6..11: note = RNA
  misc_feature 12: note = DNA
  misc_feature 13..23: note = RNA
attttaagtgaagttacttctgg

SEQ ID NO: 958 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-deoxythimidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = adenosine-2'-phosphate
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6..11: note = RNA
  misc_feature 12: note = DNA
  misc_feature 13..23: note = RNA
attttaagtgaagttacttctgg

SEQ ID NO: 959 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-deoxythimidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = adenosine-2'-phosphate
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-fluoroadenosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6..11: note = RNA
  misc_feature 12: note = DNA
  misc_feature 13..23: note = RNA
attttaagtgaagttacttctct

SEQ ID NO: 960 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-deoxythimidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = adenosine-2'-phosphate
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6..11: note = RNA
  misc_feature 12: note = DNA
  misc_feature 13..23: note = RNA
attttaagtgaagttacttctct

SEQ ID NO: 961 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-deoxythimidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = adenosine-2'-phosphate
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-fluoroadenosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphorothioate
  modified_base 20: mod_base = OTHER; note = 2'-O-methylcytidine-3'- phosphorothioate
  modified_base 21: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6..11: note = RNA
  misc_feature 12: note = DNA
  misc_feature 13..21: note = RNA
attttaagtgaagttacttct

SEQ ID NO: 962 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-deoxythimidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = adenosine-2'-phosphate
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphorothioate
  modified_base 20: mod_base = OTHER; note = 2'-O-methylcytidine-3'- phosphorothioate
  modified_base 21: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6..11: note = RNA
  misc_feature 12: note = DNA
  misc_feature 13..21: note = RNA
attttaagtgaagttacttct

SEQ ID NO: 963 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-fluorouridine -3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = adenosine-2'-phosphate
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-fluoroadenosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  modified_base 23: mod_base = OTHER; note = 2'-O-methylguanosine-3'-phosphate
  misc_feature 1..4: note = RNA
  misc_feature 5: note = DNA
  misc_feature 6..23: note = RNA
attttaagtgaagttagttctgg

SEQ ID NO: 964 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-fluorouridine -3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = adenosine-2'-phosphate
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-fluoroadenosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  modified_base 23: mod_base = OTHER; note = 2'-O-methylguanosine-3'-phosphate
  misc_feature 1..4: note = RNA
  misc_feature 5: note = DNA
  misc_feature 6..23: note = RNA
attttaagtgaagttacatctgg

SEQ ID NO: 965 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-fluorouridine -3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = adenosine-2'-phosphate
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-fluoroadenosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  modified_base 23: mod_base = OTHER; note = 2'-O-methylguanosine-3'-phosphate
  misc_feature 1..4: note = RNA
  misc_feature 5: note = DNA
  misc_feature 6..23: note = RNA
attttaagtgaagttactactgg

SEQ ID NO: 966 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-deoxycytidine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = Thymidine-glycol nucleic acid (GNA) S-Isomer
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-fluorouridine-3'-phosphate
  modified_base 15: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6..11: note = RNA
  misc_feature 12: note = DNA
  misc_feature 13..15: note = RNA
  misc_feature 16: note = DNA
  misc_feature 17..23: note = RNA
acatcgtctaacatagcaaatct

SEQ ID NO: 967 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-deoxycytidine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = uridine-2'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-fluorouridine-3'-phosphate
  modified_base 15: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6..11: note = RNA
  misc_feature 12: note = DNA
  misc_feature 13..15: note = RNA
  misc_feature 16: note = DNA
  misc_feature 17..23: note = RNA
acatcgtctaacatagcaaatct

SEQ ID NO: 968 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyluridine-3'-phosphorothioate
  modified_base 2: mod_base = OTHER; note = 2'-deoxycytidine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = Thymidine-glycol nucleic acid (GNA) S-Isomer
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-fluorouridine-3'-phosphate
  modified_base 15: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6..11: note = RNA
  misc_feature 12: note = DNA
  misc_feature 13..15: note = RNA
  misc_feature 16: note = DNA
  misc_feature 17..23: note = RNA
tcatcgtctaacatagcaaatct

SEQ ID NO: 969 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyluridine-3'-phosphorothioate
  modified_base 2: mod_base = OTHER; note = 2'-deoxycytidine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = uridine-2'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-fluorouridine-3'-phosphate
  modified_base 15: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6..11: note = RNA
  misc_feature 12: note = DNA
  misc_feature 13..15: note = RNA
  misc_feature 16: note = DNA
  misc_feature 17..23: note = RNA
tcatcgtctaacatagcaaatct

SEQ ID NO: 970 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyluridine-3'-phosphorothioate
  modified_base 2: mod_base = OTHER; note = 2'-deoxycytidine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = Thymidine-glycol nucleic acid (GNA) S-Isomer
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-fluorouridine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6..11: note = RNA
  misc_feature 12: note = DNA
  misc_feature 13..23: note = RNA
tcatcgtctaacatagcaaatct

SEQ ID NO: 971 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyluridine-3'-phosphorothioate
  modified_base 2: mod_base = OTHER; note = 2'-deoxycytidine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = uridine-2'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-fluorouridine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6..11: note = RNA
  misc_feature 12: note = DNA
  misc_feature 13..23: note = RNA
tcatcgtctaacatagcaaatct

SEQ ID NO: 972 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-deoxycytidine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = Thymidine-glycol nucleic acid (GNA) S-Isomer
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-fluorouridine-3'-phosphate
  modified_base 15: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyladenosine-3'- phosphorothioate
  modified_base 20: mod_base = OTHER; note = 2'-O-methylguanosine-3'- phosphorothioate
  modified_base 21: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6..11: note = RNA
  misc_feature 12: note = DNA
  misc_feature 13..15: note = RNA
  misc_feature 16: note = DNA
  misc_feature 17..21: note = RNA
acatcgtctaacatagcaagt

SEQ ID NO: 973 - DNA, 21 bp, synthetic construct
  source 1..21: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-deoxycytidine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = uridine-2'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-fluorouridine-3'-phosphate
  modified_base 15: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyladenosine-3'- phosphorothioate
  modified_base 20: mod_base = OTHER; note = 2'-O-methylguanosine-3'- phosphorothioate
  modified_base 21: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6..11: note = RNA
  misc_feature 12: note = DNA
  misc_feature 13..15: note = RNA
  misc_feature 16: note = DNA
  misc_feature 17..21: note = RNA
acatcgtctaacatagcaagt

SEQ ID NO: 974 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-deoxycytidine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = uridine-2'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-fluorouridine-3'-phosphate
  modified_base 15: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6..11: note = RNA
  misc_feature 12: note = DNA
  misc_feature 13..15: note = RNA
  misc_feature 16: note = DNA
  misc_feature 17..23: note = RNA
acatcgtctaacataggaaatct

SEQ ID NO: 975 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-deoxycytidine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = uridine-2'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-fluorouridine-3'-phosphate
  modified_base 15: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6..11: note = RNA
  misc_feature 12: note = DNA
  misc_feature 13..15: note = RNA
  misc_feature 16: note = DNA
  misc_feature 17..23: note = RNA
acatcgtctaacatagctaatct

SEQ ID NO: 976 - DNA, 23 bp, synthetic construct
  source 1..23: mol_type = other DNA; note = Description of Artificial Sequence: Synthetic oligonucleotide; note = Description of Combined DNA/RNA Molecule: Synthetic oligonucleotide
  modified_base 1: mod_base = OTHER; note = 2'-O-methyladenosine-3'- phosphorothioate
  modified_base 2: mod_base = OTHER; note = 2'-deoxycytidine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = uridine-2'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-fluorouridine-3'-phosphate
  modified_base 15: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6..11: note = RNA
  misc_feature 12: note = DNA
  misc_feature 13..15: note = RNA
  misc_feature 16: note = DNA
  misc_feature 17..23: note = RNA
acatcgtctaacatagcatatct

SEQ ID NO: 977 - RNA, 21 nt, Homo sapiens
  source 1..21: mol_type = genomic RNA
aagctccttctttttattgtt

SEQ ID NO: 978 - RNA, 21 nt, Homo sapiens
  source 1..21: mol_type = genomic RNA
agctccttctttttattgttc

SEQ ID NO: 979 - RNA, 21 nt, Homo sapiens
  source 1..21: mol_type = genomic RNA
ccagaagtaacttcacttaaa

SEQ ID NO: 980 - RNA, 21 nt, Homo sapiens
  source 1..21: mol_type = genomic RNA
tgttcacaattaagctccttc

SEQ ID NO: 981 - RNA, 21 nt, Homo sapiens
  source 1..21: mol_type = genomic RNA
cacaattaagctccttctttt

SEQ ID NO: 982 - RNA, 21 nt, Homo sapiens
  source 1..21: mol_type = genomic RNA
aattaagctccttctttttat

SEQ ID NO: 983 - RNA, 22 nt, Homo sapiens
  source 1..22: mol_type = genomic RNA
atttgatcagtctttttatgat

SEQ ID NO: 984 - RNA, 21 nt, Homo sapiens
  source 1..21: mol_type = genomic RNA
cagaagtaacttcacttaaaa

SEQ ID NO: 985 - RNA, 21 nt, Homo sapiens
  source 1..21: mol_type = genomic RNA
acccagaagtaacttcactta

SEQ ID NO: 986 - RNA, 21 nt, Homo sapiens
  source 1..21: mol_type = genomic RNA
agaagtaacttcacttaaaac

We claim:

1. A method of inhibiting expression of a Angiopoietin-like 3 (ANGPTL3) gene in a cell, the method comprising contacting the cell with a dsRNA agent, or salt thereof,
wherein the dsRNA agent, or salt thereof, comprises a sense strand and an antisense strand forming a double stranded region,
wherein the sense strand comprises at least 19 contiguous nucleotides of the nucleotide sequence 5'-AAGCUC-CUUCUUUUUAUUGUU-3' of SEQ ID NO:46 and the antisense strand comprises at least 21 contiguous nucleotides of the nucleotide sequence of 5'-AACAAUAAAAAGAAGGAGCUUGG-3' of SEQ ID NO:661,
wherein all of the nucleotides of the sense strand and all of the nucleotides of the antisense strand comprise a modification, and
wherein at least one of the modifications is a 2'-deoxy-nucleotide modification, thereby inhibiting expression of the ANGPTL3 gene in the cell.

2. The method of claim 1, wherein contacting the cell with the dsRNA agent, or salt thereof, inhibits the expression of ANGPTL3 by at least 50%.

3. The method of claim 1, wherein the cell is within a subject.

4. The method of claim 3, wherein the subject is a human.

5. The method of claim 3, wherein inhibiting expression of ANGPTL3 decreases ANGPTL3 protein level in serum of the subject by at least 50%.

6. The method of claim 5, wherein the subject has an ANGPTL3-associated disorder.

7. The method of claim 6, wherein the ANGPTL3-associated disorder is a disorder of lipid metabolism.

8. The method of claim 7, wherein the disorder of lipid metabolism is hyperlipidemia or hypertriglyceridemia.

9. The method of claim 1, wherein the double stranded region is 19-30 nucleotide pairs in length.

10. The method of claim 1, wherein the double stranded region is 21-23 nucleotide pairs in length.

11. The method of claim 1, wherein each strand is independently 19-30 nucleotides in length.

12. The method of claim 1, wherein at least one strand comprises a 3' overhang of at least 1 nucleotide.

13. The method of claim 1, wherein the dsRNA agent, or salt thereof, further comprises a ligand.

14. The method of claim 13, wherein the ligand is conjugated to the 3' end of the sense strand of the dsRNA agent, or salt thereof.

15. The method of claim 13, wherein the ligand is an N-acetylgalactosamine (GalNAc) derivative.

16. The method of claim 13, wherein the ligand is one or more GalNAc derivatives attached through a monovalent, bivalent, or trivalent linker.

17. The method of claim 16, wherein the ligand is

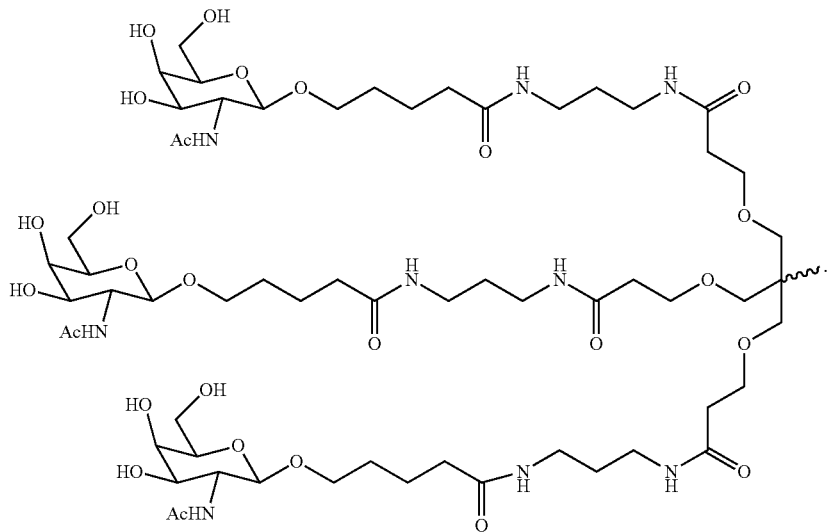 [SMILES: CC(=O)NC1C(OCCCCC(=O)NCCCNC(=O)CCOCC(C)(COCCC(=O)NCCCNC(=O)CCCCOC2OC(CO)C(O)C(O)C2NC(C)=O)COCCC(=O)NCCCNC(=O)CCCCOC2OC(CO)C(O)C(O)C2NC(C)=O)OC(CO)C(O)C1O]

18. The method of claim 17, wherein the dsRNA agent, or salt thereof, is conjugated to the ligand as shown in the following schematic

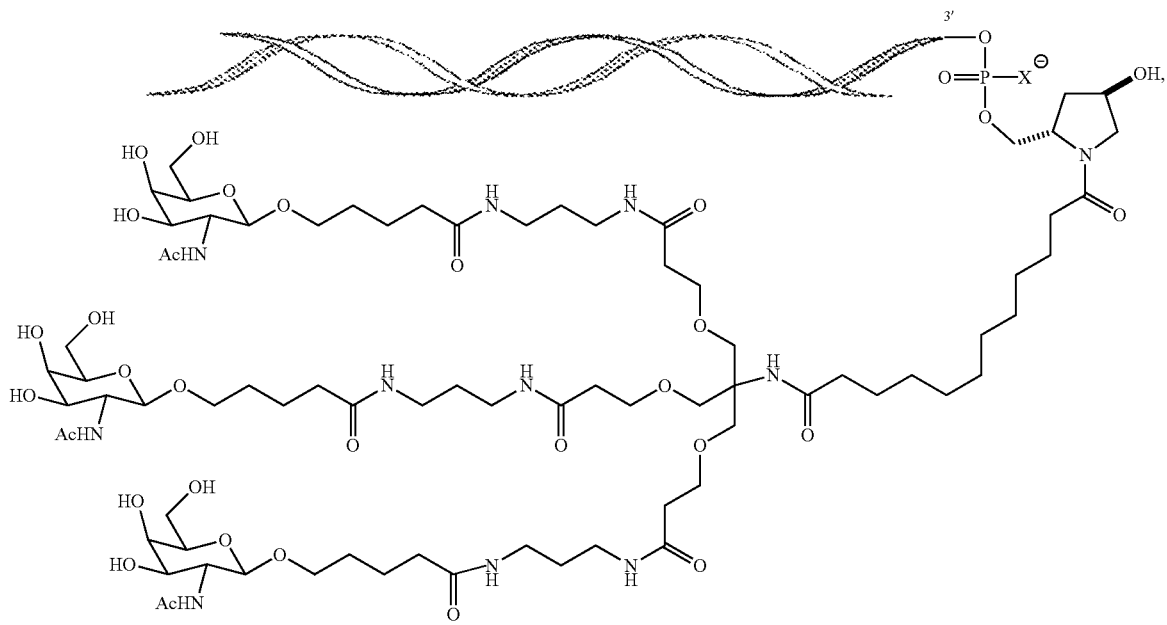

wherein X is O or S.

19. The method of claim 18, wherein X is O.

20. The method of claim 1, wherein the dsRNA agent, or salt thereof, further comprises at least one phosphorothioate or methylphosphonate internucleotide linkage.

21. The method of claim 20, wherein the phosphorothioate or methylphosphonate internucleotide linkage is at the 3'-terminus of one strand; the 5'-terminus of one strand; or at both the 5'- and 3'-terminus of one strand.

22. The method of claim 1, wherein the sense strand is 21 nucleotides in length and the antisense strand is 23 nucleotides in length.

23. The method of claim 1, wherein the sense strand comprises the nucleotide sequence 5'-AAGCUCCUUC-UUUUUAUUGUU-3' of SEQ ID NO: 46.

24. The method of claim 1, wherein the sense strand comprises the nucleotide sequence 5'-AAGCUCCUUC-UUUUUAUUGUU-3' of SEQ ID NO: 46 and the antisense strand comprises the nucleotide sequence 5'-AACAAUAAAAAGAAGGAGCUUGG-3' of SEQ ID NO:661.

25. The method of claim 1, wherein the sense strand consists of the nucleotide sequence 5'-AAGCUCCUUC-UUUUUAUUGUU-3' of SEQ ID NO:46 and the antisense strand consists of the nucleotide sequence 5'-AACAAUAAAAAGAAGGAGCUUGG-3' of SEQ ID NO:661.

26. The method of claim 1, wherein the nucleotide sequence of the sense strand differs by no more than 4 bases from the nucleotide sequence 5'-asasgcuccuUfCfU-fuuuuauuguu-3' of SEQ ID NO: 18 and the nucleotide sequence of the antisense strand differs by no more than 4 bases from the nucleotide sequence 5'-asdAscadAudAaaaadGaAfggagcuusgsg-3' of SEQ ID NO:19,
wherein a, g, c and u are 2'-O-methyl (2'-OMe) A, G, C, and U, respectively; dA and dG, are 2'-deoxy A and G, respectively; Af, Cf and Uf are 2'-fluoro (2'-F) A, C and U, respectively; and s is a phosphorothioate linkage.

27. The method of claim 1, wherein the nucleotide sequence of the sense strand differs by no more than 3 bases from the nucleotide sequence 5'-asasgcuccuUfCfU-fuuuuauuguu-3' of SEQ ID NO: 18 and the nucleotide sequence of the antisense strand differs by no more than 3 bases from the nucleotide sequence 5'-asdAscadAudAaaaadGaAfggagcuusgsg-3' of SEQ ID NO: 19,
wherein a, g, c and u are 2'-O-methyl (2'-OMe) A, G, C, and U, respectively; dA and dG, are 2'-deoxy A and G, respectively; Af, Cf and Uf are 2'-fluoro (2'-F) A, C and U, respectively; and s is a phosphorothioate linkage.

28. The method of claim 1, wherein the nucleotide sequence of the sense strand differs by no more than 2 bases from the nucleotide sequence 5'-asasgcuccuUfCfU-fuuuuauuguu-3' of SEQ ID NO: 18 and the nucleotide sequence of the antisense strand differs by no more than 2 bases from the nucleotide sequence 5'-asdAscadAudAaaaadGaAfggagcuusgsg-3' of SEQ ID NO:19,
wherein a, g, c and u are 2'-O-methyl (2'-OMe) A, G, C, and U, respectively; dA and dG, are 2'-deoxy A and G, respectively; Af, Cf and Uf are 2'-fluoro (2'-F) A, C and U, respectively; and s is a phosphorothioate linkage.

29. The method of claim 1, wherein the nucleotide sequence of the sense strand differs by no more than 1 base from the nucleotide sequence 5'-asasgcuccuUfCfU-fuuuuauuguu-3' of SEQ ID NO: 18 and the nucleotide sequence of the antisense strand differs by no more than 1 base from the nucleotide sequence 5'-asdAscadAudAaaaadGaAfggagcuusgsg-3' of SEQ ID NO:19,
wherein a, g, c and u are 2'-O-methyl (2'-OMe) A, G, C, and U, respectively; dA and dG, are 2'-deoxy A and G, respectively; Af, Cf and Uf are 2'-fluoro (2'-F) A, C and U, respectively; and s is a phosphorothioate linkage.

30. The method of claim 1, wherein the sense strand comprises the nucleotide sequence 5'-asasgcuccuUfCfU-fuuuuauuguu-3' of SEQ ID NO:18 and the antisense strand comprises the nucleotide sequence 5'-asdAscadAudAaaaadGaAfggagcuusgsg-3' of SEQ ID NO:19,
wherein a, g, c and u are 2'-O-methyl (2'-OMe) A, G, C, and U, respectively; dA and dG, are 2'-deoxy A and G, respectively; Af, Cf and Uf are 2'-fluoro (2'-F) A, C and U, respectively; and s is a phosphorothioate linkage.

31. The method of claim 1, wherein the sense strand consists of the nucleotide sequence 5'-asasgcuccuUfCfU-fuuuuauuguu-3' of SEQ ID NO:18 and the antisense strand consists of the nucleotide sequence 5'-asdAscadAudAaaaadGaAfggagcuusgsg-3' of SEQ ID NO:19,
wherein a, g, c and u are 2'-O-methyl (2'-OMe) A, G, C, and U, respectively; dA and dG, are 2'-deoxy A and G, respectively; Af, Cf and Uf are 2'-fluoro (2'-F) A, C and U, respectively; and s is a phosphorothioate linkage.

32. The method of claim 1, wherein the sense strand comprises the nucleotide sequence 5'-asasgcuccuUfCfU-fuuuuauuguu-L96-3' of SEQ ID NO:20 and the antisense strand comprises the nucleotide sequence 5'-asdAscadAudAaaaadGaAfggagcuusgsg-3' of SEQ ID NO: 19,
wherein a, g, c and u are 2'-O-methyl (2'-OMe) A, G, C, and U, respectively; dA and dG, are 2'-deoxy A and G, respectively; Af, Cf and Uf are 2'-fluoro (2'-F) A, C and U, respectively; and s is a phosphorothioate linkage, and
wherein L96 is a ligand conjugated to the 3'-end of the sense strand as shown in the following schematic

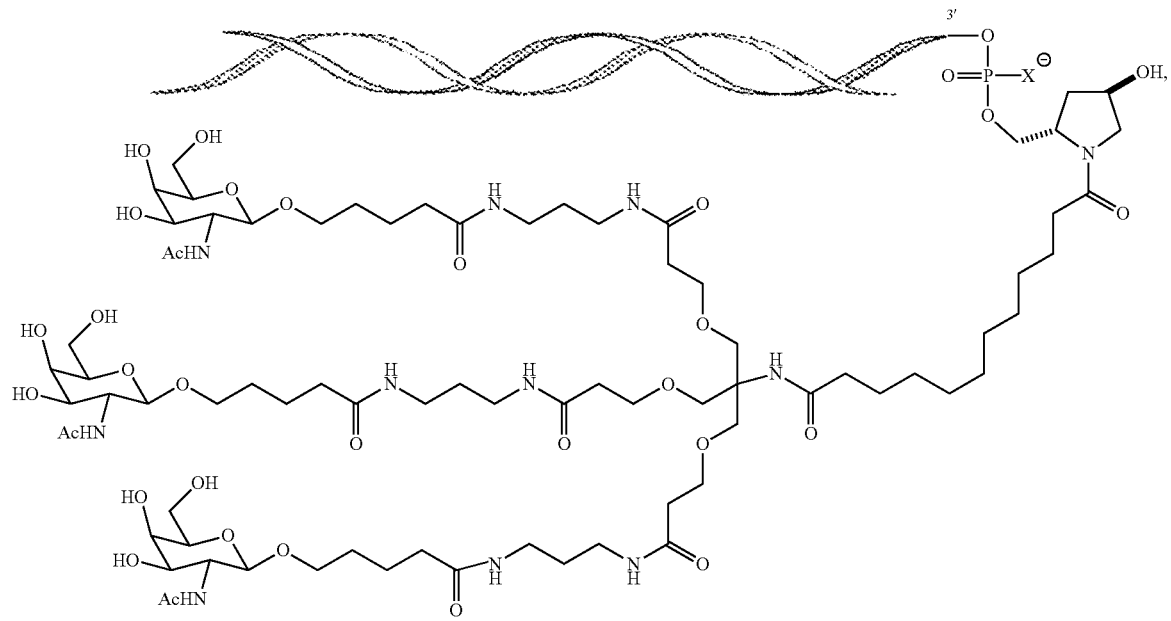

wherein X is O.

33. A method of treating a subject having a disorder that would benefit from reduction in Angiopoietin-like 3 (ANGPTL3) expression, comprising administering to the subject a therapeutically effective amount of a dsRNA agent, or salt thereof,
   wherein the dsRNA agent, or salt thereof comprises a sense strand and an antisense strand forming a double stranded region,
   wherein the sense strand comprises at least 19 contiguous nucleotides of the nucleotide sequence 5'-AAGCUC-CUUCUUUUAUUGUU-3' of SEQ ID NO:46 and the antisense strand comprises at least 21 contiguous nucleotides of the nucleotide sequence of 5'-AACAAUAAAAGAAGGAGCUUGG-3' of SEQ ID NO:661,
   wherein all of the nucleotides of the sense strand and all of the nucleotides of the antisense strand comprise a modification, and
   wherein at least one of the modifications is a 2'-deoxy-nucleotide modification, thereby treating the subject having the disorder that would benefit from reduction in ANGPTL3 expression.

34. The method of claim 33, wherein the subject is a human.

35. The method of claim 33, wherein the disorder is an ANGPTL3-associated disorder.

36. The method of claim 35, wherein the ANGPTL3-associated disorder is a disorder of lipid metabolism.

37. The method of claim 36, wherein the disorder of lipid metabolism is hyperlipidemia or hypertriglyceridemia.

38. The method of claim 33, wherein the administration of the dsRNA agent, or salt thereof, to the subject causes a decrease in one or more serum lipid and/or a decrease in ANGPTL3 protein accumulation.

39. The method of claim 33, wherein the dsRNA agent, or salt thereof, is administered to the subject subcutaneously.

40. The method of claim 33, further comprising administering to the subject an additional therapeutic agent for treatment of an ANGPTL3-associated disorder.

41. The method of claim 33, wherein the double stranded region is 19-30 nucleotide pairs in length.

42. The method of claim 33, wherein the double stranded region is 21-23 nucleotide pairs in length.

43. The method of claim 33, wherein each strand is independently 19-30 nucleotides in length.

44. The method of claim 33, wherein at least one strand comprises a 3' overhang of at least 1 nucleotide.

45. The method of claim 33, wherein the dsRNA agent, or salt thereof, further comprises a ligand.

46. The method of claim 45, wherein the ligand is conjugated to the 3' end of the sense strand of the dsRNA agent, or salt thereof.

47. The method of claim 45, wherein the ligand is an N-acetylgalactosamine (GalNAc) derivative.

48. The method of claim 45, wherein the ligand is one or more GalNAc derivatives attached through a monovalent, bivalent, or trivalent linker.

49. The method of claim 48, wherein the ligand is

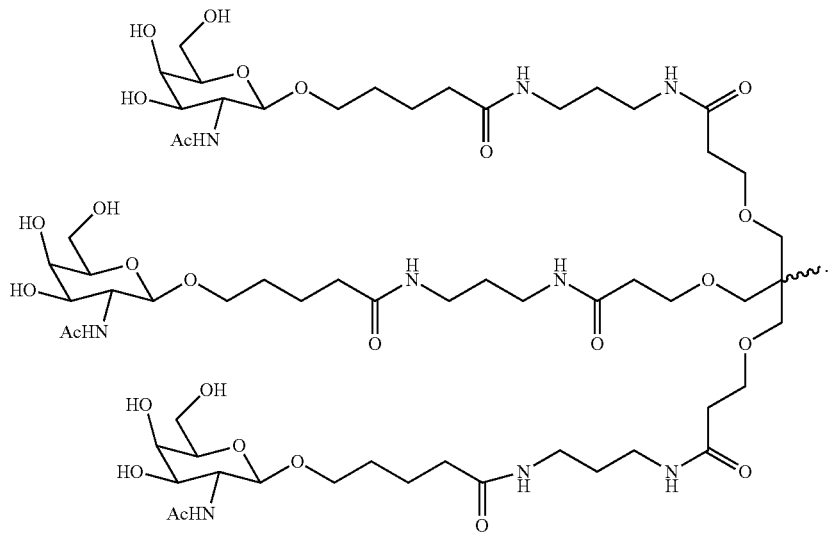 [SMILES: CC(=O)NC1C(OCCCCC(=O)NCCCNC(=O)CCOCC(C)(COCCC(=O)NCCCNC(=O)CCCCOC2OC(CO)C(O)C(O)C2NC(C)=O)COCCC(=O)NCCCNC(=O)CCCCOC2OC(CO)C(O)C(O)C2NC(C)=O)OC(CO)C(O)C1O]

50. The method of claim 49, wherein the dsRNA agent, or salt thereof, is conjugated to the ligand as shown in the following schematic

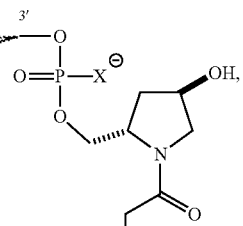
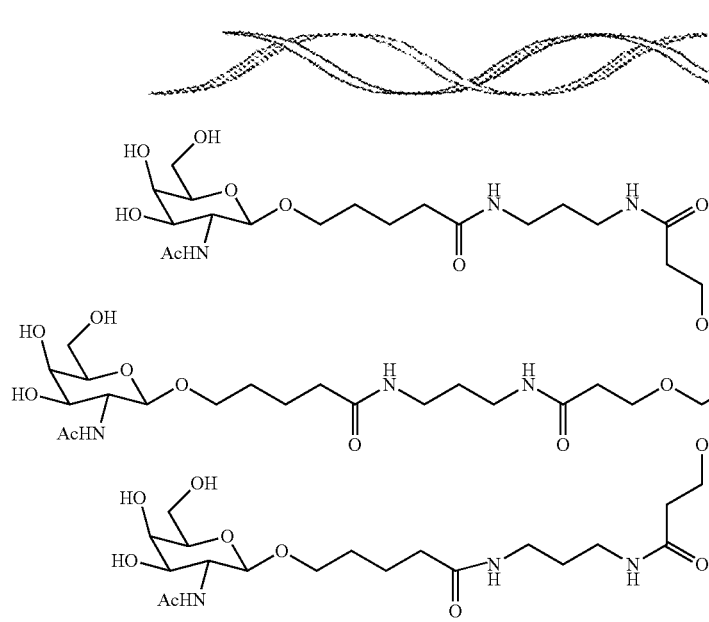

wherein X is O or S.

51. The method of claim 50, wherein X is O.

52. The method of claim 33, wherein the dsRNA agent, or salt thereof, further comprises at least one phosphorothioate or methylphosphonate internucleotide linkage.

53. The method of claim 52, wherein the phosphorothioate or methylphosphonate internucleotide linkage is at the 3'-terminus of one strand; the 5'-terminus of one strand; or at both the 5'- and 3'-terminus of one strand.

54. The method of claim 33, wherein the sense strand is 21 nucleotides in length and the antisense strand is 23 nucleotides in length.

55. The method of claim 33, wherein the sense strand comprises the nucleotide sequence 5'-AAGCUCCUUC-UUUUUAUUGUU-3' of SEQ ID NO:46.

56. The method of claim 33, wherein the sense strand comprises the nucleotide sequence 5'-AAGCUCCUUC-UUUUUAUUGUU-3' of SEQ ID NO:46 and the antisense strand comprises the nucleotide sequence 5'-AACAAUAAAAAGAAGGAGCUUGG-3' of SEQ ID NO:661.

57. The method of claim 33, wherein the sense strand consists of the nucleotide sequence 5'-AAGCUCCUUC-UUUUUAUUGUU-3' of SEQ ID NO:46 and the antisense strand consists of the nucleotide sequence 5'-AACAAUAAAAAGAAGGAGCUUGG-3' of SEQ ID NO:661.

58. The method of claim 33, wherein the nucleotide sequence of the sense strand differs by no more than 4 bases from the nucleotide sequence 5'-asasgcuccuUfCfU-fuuuuauuguu-3' of SEQ ID NO: 18 and the nucleotide sequence of the antisense strand differs by no more than 4 bases from the nucleotide sequence 5'-asdAs-cadAudAaaaadGaAfggagcuusgsg-3' of SEQ ID NO:19,
    wherein a, g, c and u are 2'-O-methyl (2'-OMe) A, G, C, and U, respectively; dA and dG, are 2'-deoxy A and G, respectively; Af, Cf and Uf are 2'-fluoro (2'-F) A, C and U, respectively; and s is a phosphorothioate linkage.

59. The method of claim 33, wherein the nucleotide sequence of the sense strand differs by no more than 3 bases from the nucleotide sequence 5'-asasgcuccuUfCfU-fuuuuauuguu-3' of SEQ ID NO: 18 and the nucleotide sequence of the antisense strand differs by no more than 3 bases from the nucleotide sequence 5'-asdAs-cadAudAaaaadGaAfggagcuusgsg-3' of SEQ ID NO: 19,
    wherein a, g, c and u are 2'-O-methyl (2'-OMe) A, G, C, and U, respectively; dA and dG, are 2'-deoxy A and G, respectively; Af, Cf and Uf are 2'-fluoro (2'-F) A, C and U, respectively; and s is a phosphorothioate linkage.

60. The method of claim 33, wherein the nucleotide sequence of the sense strand differs by no more than 2 bases from the nucleotide sequence 5'-asasgcuccuUfCfU-fuuuuauuguu-3' of SEQ ID NO: 18 and the nucleotide sequence of the antisense strand differs by no more than 2 bases from the nucleotide sequence 5'-asdAs-cadAudAaaaadGaAfggagcuusgsg-3' of SEQ ID NO:19,
    wherein a, g, c and u are 2'-O-methyl (2'-OMe) A, G, C, and U, respectively; dA and dG, are 2'-deoxy A and G, respectively; Af, Cf and Uf are 2'-fluoro (2'-F) A, C and U, respectively; and s is a phosphorothioate linkage.

61. The method of claim 33, wherein the nucleotide sequence of the sense strand differs by no more than 1 base from the nucleotide sequence 5'-asasgcuccuUfCfU-fuuuuauuguu-3' of SEQ ID NO: 18 and the nucleotide sequence of the antisense strand differs by no more than 1 base from the nucleotide sequence 5'-asdAscadAudAaaaad-GaAfggagcuusgsg-3' of SEQ ID NO:19,
    wherein a, g, c and u are 2'-O-methyl (2'-OMe) A, G, C, and U, respectively; dA and dG, are 2'-deoxy A and G, respectively; Af, Cf and Uf are 2'-fluoro (2'-F) A, C and U, respectively; and s is a phosphorothioate linkage.

62. The method of claim 33, wherein the sense strand comprises the nucleotide sequence 5'-asasgcuccuUfCfU-fuuuuauuguu-3' of SEQ ID NO:18 and the antisense strand comprises the nucleotide sequence 5'-asdAscadAudAaaaad-GaAfggagcuusgsg-3' of SEQ ID NO:19,
    wherein a, g, c and u are 2'-O-methyl (2'-OMe) A, G, C, and U, respectively; dA and dG, are 2'-deoxy A and G, respectively; Af, Cf and Uf are 2'-fluoro (2'-F) A, C and U, respectively; and s is a phosphorothioate linkage.

63. The method of claim 33, wherein the sense strand consists of the nucleotide sequence 5'-asasgcuccuUfCfU-fuuuuauuguu-3' of SEQ ID NO: 18 and the antisense strand consists of the nucleotide sequence 5'-asdAscadAudAaaaad-GaAfggagcuusgsg-3' of SEQ ID NO:19,
  wherein a, g, c and u are 2'-O-methyl (2'-OMe) A, G, C, and U, respectively; dA and dG, are 2'-deoxy A and G, respectively; Af, Cf and Uf are 2'-fluoro (2'-F) A, C and U, respectively; and s is a phosphorothioate linkage.

64. The method of claim 33, wherein the sense strand comprises the nucleotide sequence 5'-asasgcuccuUfCfU-fuuuuauuguu-L96-3' of SEQ ID NO:20 and the antisense strand comprises the nucleotide sequence 5'-asdAscadAudAaaaadGaAfggagcuusgsg-3' of SEQ ID NO:19,
  wherein a, g, c and u are 2'-O-methyl (2'-OMe) A, G, C, and U, respectively; dA and dG, are 2'-deoxy A and G, respectively; Af, Cf and Uf are 2'-fluoro (2'-F) A, C and U, respectively; and s is a phosphorothioate linkage, and
  wherein L96 is a ligand conjugated to the 3'-end of the sense strand as shown in the following schematic

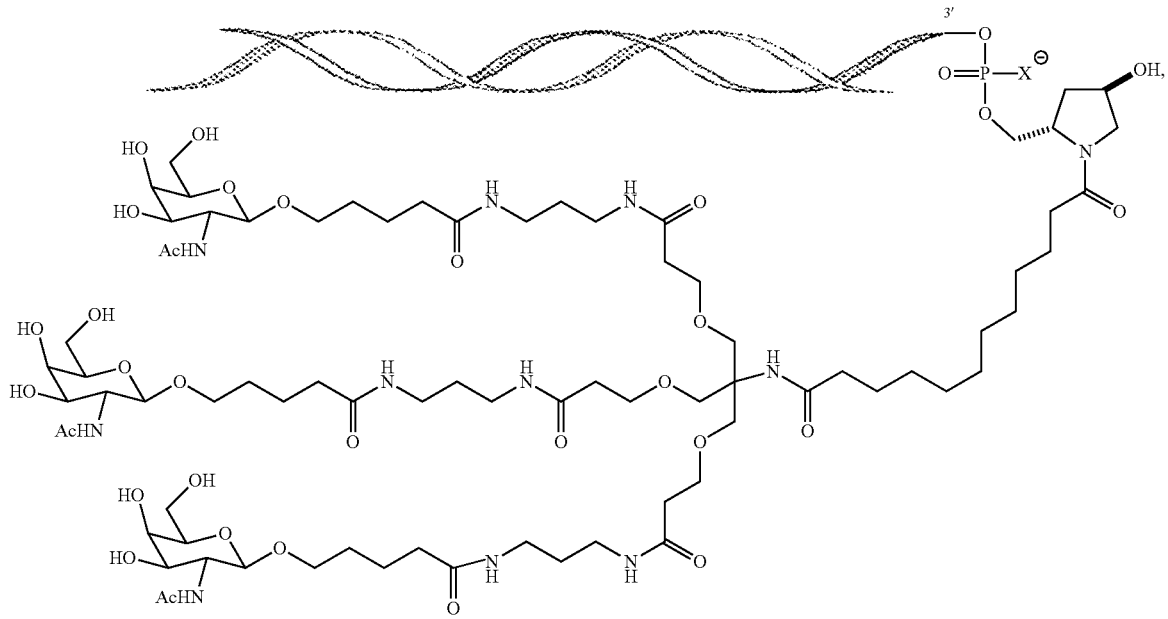

wherein X is O.

65. A method of treating a subject having a disorder that would benefit from reduction in Angiopoietin-like 3 (ANGPTL3) expression, comprising administering to the subject a therapeutically effective amount of a dsRNA agent, or salt thereof,
  wherein the dsRNA agent, or salt thereof, comprises a sense strand and an antisense strand forming a double stranded region,
  wherein the sense strand comprises the nucleotide sequence 5'-asasgcuccuUfCfUfuuuuauuguu-L96-3' of SEQ ID NO:20 and the antisense strand comprises the nucleotide sequence 5'-asdAscadAudAaaaadGaAfg-gagcuusgsg-3' of SEQ ID NO:19,
  wherein a, g, c and u are 2'-O-methyl (2'-OMe) A, G, C, and U, respectively; dA and dG, are 2'-deoxy A and G, respectively; Af, Cf and Uf are 2'-fluoro (2'-F) A, C and U, respectively; and s is a phosphorothioate linkage, and
  wherein L96 is a ligand conjugated to the 3'-end of the sense strand as shown in the following schematic

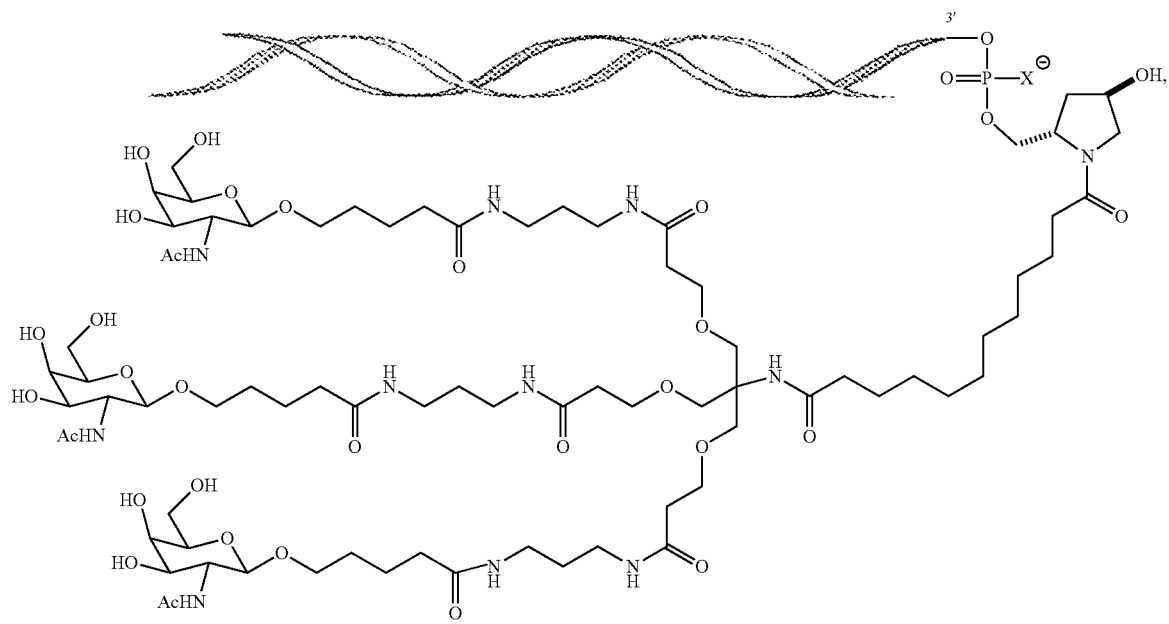

wherein X is O, thereby treating the subject.

66. The method of claim 65, wherein the subject is human.

67. The method of claim 66, wherein the disorder is an ANGPTL3-associated disorder.

68. The method of claim 67, wherein the ANGPTL3-associated disorder is a disorder of lipid metabolism.

69. The method of claim 68, wherein the disorder of lipid metabolism is hyperlipidemia or hypertriglyceridemia.

70. The method of claim 65, wherein the administration of the agent to the subject causes a decrease in one or more serum lipid and/or a decrease in ANGPTL3 protein accumulation.

71. The method of claim 65, wherein the dsRNA agent, or salt thereof, is administered to the subject subcutaneously.

72. The method of claim 65, further comprising administering to the subject an additional therapeutic agent for treatment of an ANGPTL3-associated disorder.

73. The method of claim 65, wherein the dsRNA agent is in a salt form.

74. The method of claim 65, wherein the dsRNA agent, or salt thereof, is present in a pharmaceutical composition.

75. A method of treating a subject having a disorder that would benefit from reduction in Angiopoietin-like 3 (ANGPTL3) expression, comprising administering to the subject a therapeutically effective amount of a dsRNA agent, or salt thereof,
  wherein the dsRNA agent, or salt thereof, comprises a sense strand and an antisense strand forming a double stranded region,
  wherein the sense strand consists of the nucleotide sequence 5'-asasgcuccuUfCfUfuuuuauuguu-L96-3' of SEQ ID NO:20 and the antisense strand consists of the nucleotide sequence 5'-asdAscadAudAaaaadGaAfg-gagcuusgsg-3' of SEQ ID NO:19,
  wherein a, g, c and u are 2'-O-methyl (2'-OMe) A, G, C, and U, respectively; dA and dG, are 2'-deoxy A and G, respectively; Af, Cf and Uf are 2'-fluoro (2'-F) A, C and U, respectively; and s is a phosphorothioate linkage, and
  wherein L96 is a ligand conjugated to the 3'-end of the sense strand as shown in the following schematic

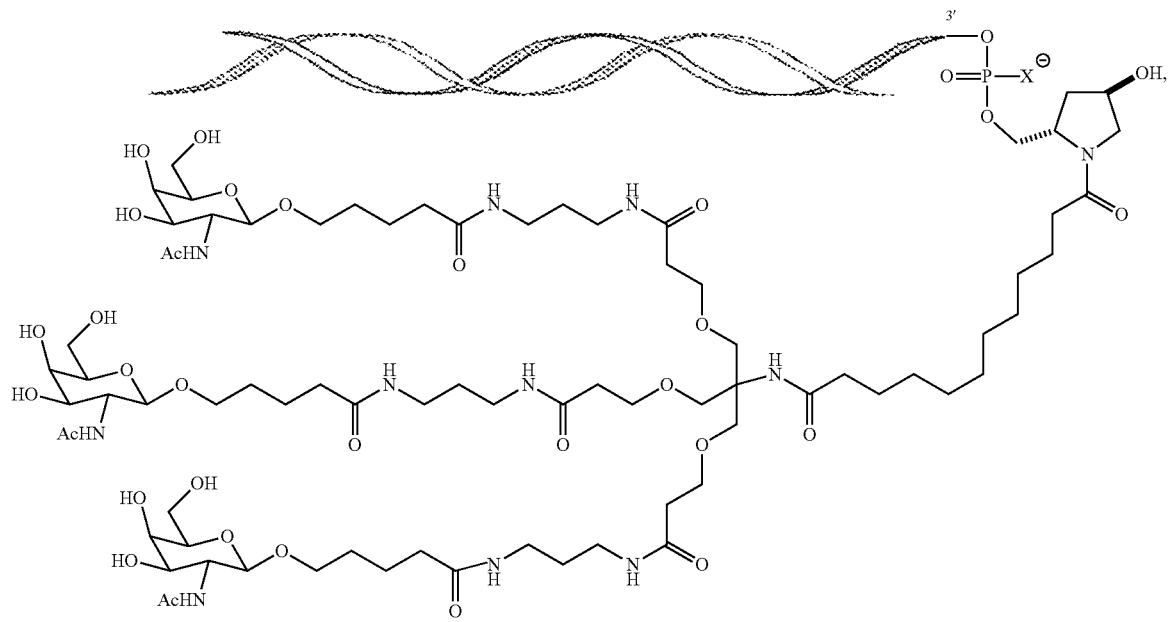

wherein X is O, thereby treating the subject.

76. The method of claim 75, wherein the subject is human.

77. The method of claim 76, wherein the disorder is an ANGPTL3-associated disorder.

78. The method of claim 77, wherein the ANGPTL3-associated disorder is a disorder of lipid metabolism.

79. The method of claim 78, wherein the disorder of lipid metabolism is hyperlipidemia or hypertriglyceridemia.

80. The method of claim 75, wherein the administration of the agent to the subject causes a decrease in one or more serum lipid and/or a decrease in ANGPTL3 protein accumulation.

81. The method of claim 75, wherein the dsRNA agent, or salt thereof, is administered to the subject subcutaneously.

82. The method of claim 75, further comprising administering to the subject an additional therapeutic agent for treatment of an ANGPTL3-associated disorder.

83. The method of claim 75, wherein the dsRNA agent is in a salt form.

84. The method of claim 75, wherein the dsRNA agent, or salt thereof, is present in a pharmaceutical composition.

* * * * *